United States Patent
Aznarez et al.

(10) Patent No.: US 11,083,745 B2
(45) Date of Patent: Aug. 10, 2021

(54) ANTISENSE OLIGOMERS FOR TREATMENT OF AUTOSOMAL DOMINANT MENTAL RETARDATION-5 AND DRAVET SYNDROME

(71) Applicants: Cold Spring Harbor Laboratory, Cold Spring Harbor, NY (US); Stoke Therapeutics, Inc., Bedford, MA (US)

(72) Inventors: Isabel Aznarez, Cambridge, MA (US); Huw M. Nash, Lexington, MA (US); Adrian Krainer, East Northport, NY (US)

(73) Assignees: COLD SPRING HARBOR LABORATORY, Cold Spring Harbor, NY (US); STOKE THERAPEUTICS, INC., Bedford, MA (US)

( * ) Notice: Subject to any disclaimer, the term of this patent is extended or adjusted under 35 U.S.C. 154(b) by 0 days.

(21) Appl. No.: 16/062,286

(22) PCT Filed: Dec. 14, 2016

(86) PCT No.: PCT/US2016/066708
§ 371 (c)(1),
(2) Date: Jun. 14, 2018

(87) PCT Pub. No.: WO2017/106377
PCT Pub. Date: Jun. 22, 2017

(65) Prior Publication Data
US 2018/0369275 A1     Dec. 27, 2018

Related U.S. Application Data

(60) Provisional application No. 62/267,251, filed on Dec. 14, 2015.

(51) Int. Cl.
| | | |
|---|---|---|
| *C07H 21/04* | (2006.01) | |
| *A61K 31/7125* | (2006.01) | |
| *A61K 31/712* | (2006.01) | |
| *C12Q 1/6883* | (2018.01) | |
| *C12N 15/113* | (2010.01) | |
| *C12Q 1/68* | (2018.01) | |
| *A61K 31/713* | (2006.01) | |
| *A61P 43/00* | (2006.01) | |

(52) U.S. Cl.
CPC ........ *A61K 31/7125* (2013.01); *A61K 31/712* (2013.01); *A61K 31/713* (2013.01); *A61P 43/00* (2018.01); *C12N 15/1138* (2013.01); *C12Q 1/68* (2013.01); *C12Q 1/6883* (2013.01); *A61K 2300/00* (2013.01); *C12N 2310/11* (2013.01); *C12N 2310/315* (2013.01); *C12N 2310/346* (2013.01); *C12N 2320/33* (2013.01); *C12Q 2600/158* (2013.01)

(58) Field of Classification Search
USPC ...................................................... 536/24.5
See application file for complete search history.

(56) References Cited

U.S. PATENT DOCUMENTS

| | | |
|---|---|---|
| 4,866,042 A | 9/1989 | Neuwelt |
| 5,151,510 A | 9/1992 | Stec et al. |
| 5,656,612 A | 8/1997 | Monia |
| 5,665,593 A | 9/1997 | Kole et al. |
| 5,914,396 A | 6/1999 | Cook et al. |
| 5,916,808 A | 6/1999 | Kole et al. |
| 5,976,879 A | 11/1999 | Kole et al. |
| 6,083,482 A | 7/2000 | Wang |
| 6,166,197 A | 12/2000 | Cook et al. |
| 6,210,892 B1 | 4/2001 | Bennett et al. |
| 6,294,520 B1 | 9/2001 | Naito |
| 6,383,752 B1 | 5/2002 | Agrawal et al. |
| 6,436,657 B1 | 8/2002 | Famodu et al. |
| 6,451,991 B1 | 9/2002 | Martin et al. |
| 6,485,960 B1 | 11/2002 | Harris et al. |
| 6,531,591 B1 | 3/2003 | Fensholdt |
| 6,573,073 B2 | 6/2003 | Harris |
| 6,605,611 B2 | 8/2003 | Simmonds et al. |
| 6,632,427 B1 | 10/2003 | Finiels et al. |
| 6,639,059 B1 | 10/2003 | Kochkine et al. |
| 6,670,461 B1 | 12/2003 | Wengel et al. |
| 6,677,445 B1 | 1/2004 | Innis et al. |
| 6,734,291 B2 | 5/2004 | Kochkine et al. |
| 6,756,523 B1 | 6/2004 | Kahn et al. |
| 6,770,748 B2 | 8/2004 | Imanishi et al. |
| 6,794,499 B2 | 9/2004 | Wengel et al. |
| 6,846,921 B2 | 1/2005 | Innis et al. |
| 6,936,589 B2 | 8/2005 | Naito |

(Continued)

FOREIGN PATENT DOCUMENTS

| | | |
|---|---|---|
| CN | 103667438 A | 3/2014 |
| EP | 0549615 A1 | 7/1993 |

(Continued)

OTHER PUBLICATIONS

Audentes Therapeutics Announces Expansion of AAV Technology Platform and Pipeline with New Development Programs for Duchenne Muscular Dystrophy and Myotonic Dystrophy. PRNewswire Apr. 8, 2019 (7 pgs).

(Continued)

*Primary Examiner* — Kimberly Chong
(74) *Attorney, Agent, or Firm* — Wilson Sonsini Goodrich & Rosati

(57) ABSTRACT

Provided herein are methods and compositions for treating a subject in need thereof, such as a subject with deficient SYNGAP1 protein or SCN1A protein expression or a subject having AD mental retardation 5 or Dravet syndrome.

36 Claims, 14 Drawing Sheets

Specification includes a Sequence Listing.

(56) References Cited

U.S. PATENT DOCUMENTS

| | | |
|---|---|---|
| 6,963,589 B1 | 11/2005 | Sugata et al. |
| 6,998,484 B2 | 2/2006 | Koch et al. |
| 7,015,315 B1 | 3/2006 | Cook et al. |
| 7,034,133 B2 | 4/2006 | Wengel et al. |
| 7,053,199 B2 | 5/2006 | Imanishi et al. |
| 7,053,207 B2 | 5/2006 | Wengel |
| 7,060,809 B2 | 6/2006 | Wengel et al. |
| 7,071,324 B2 | 7/2006 | Preparata et al. |
| 7,084,125 B2 | 8/2006 | Wengel |
| 7,101,993 B1 | 9/2006 | Cook et al. |
| 7,169,594 B2 | 1/2007 | Guan |
| 7,214,783 B2 | 5/2007 | Jeon et al. |
| 7,217,805 B2 | 5/2007 | Imanishi et al. |
| 7,314,923 B2 | 1/2008 | Kaneko et al. |
| 7,335,765 B2 | 2/2008 | Kaneko et al. |
| 7,368,549 B2 | 5/2008 | Dempcy et al. |
| 7,399,845 B2 | 7/2008 | Seth et al. |
| 7,432,249 B2 | 10/2008 | Crooke |
| 7,432,250 B2 | 10/2008 | Crooke |
| 7,547,684 B2 | 6/2009 | Seth et al. |
| 7,553,644 B2 | 6/2009 | Germino et al. |
| 7,569,575 B2 | 8/2009 | Soerensen et al. |
| 7,569,686 B1 | 8/2009 | Bhat et al. |
| 7,572,582 B2 | 8/2009 | Wengel et al. |
| 7,595,304 B2 | 9/2009 | Zhao et al. |
| 7,615,619 B2 | 11/2009 | Imanishi et al. |
| 7,662,946 B2 | 2/2010 | Ginsburg et al. |
| 7,662,948 B2 | 2/2010 | Kurreck et al. |
| 7,666,854 B2 | 2/2010 | Seth et al. |
| 7,687,617 B2 | 3/2010 | Thrue et al. |
| 7,696,345 B2 | 4/2010 | Allerson et al. |
| 7,741,457 B2 | 6/2010 | Seth et al. |
| 7,750,131 B2 | 7/2010 | Seth et al. |
| 7,816,333 B2 | 10/2010 | Kaneko et al. |
| 7,846,686 B2 | 12/2010 | Kramer |
| 7,951,934 B2 | 5/2011 | Freier |
| 7,994,145 B2 | 8/2011 | Imanishi et al. |
| 8,022,193 B2 | 9/2011 | Seth et al. |
| 8,030,467 B2 | 10/2011 | Seth et al. |
| 8,048,998 B2 | 11/2011 | Rasmussen et al. |
| 8,067,569 B2 | 11/2011 | Iversen et al. |
| 8,084,458 B2 | 12/2011 | Soerensen et al. |
| 8,088,746 B2 | 1/2012 | Seth et al. |
| 8,110,674 B2 | 2/2012 | Manoharan et al. |
| 8,124,745 B2 | 2/2012 | Allerson et al. |
| 8,129,515 B2 | 3/2012 | Esau et al. |
| 8,168,605 B2 | 5/2012 | Zhao et al. |
| 8,258,109 B2 | 9/2012 | Bennett et al. |
| 8,268,980 B2 | 9/2012 | Seth et al. |
| 8,278,036 B2 | 10/2012 | Kariko et al. |
| 8,278,283 B2 | 10/2012 | Seth et al. |
| 8,278,425 B2 | 10/2012 | Prakash et al. |
| 8,278,426 B2 | 10/2012 | Seth et al. |
| 8,293,684 B2 | 10/2012 | Mouritzen et al. |
| 8,361,979 B2 | 1/2013 | Aartsma-Rus et al. |
| 8,383,792 B2 | 2/2013 | Okamoto et al. |
| 8,394,947 B2 | 3/2013 | Bhat et al. |
| 8,415,465 B2 | 4/2013 | Freier |
| 8,436,163 B2 | 5/2013 | Iversen et al. |
| 8,450,467 B2 | 5/2013 | Manoharan et al. |
| 8,461,124 B2 | 6/2013 | Chattopadhyaya |
| 8,492,390 B2 | 7/2013 | Detlef et al. |
| 8,501,703 B2 | 8/2013 | Bennett et al. |
| 8,501,805 B2 | 8/2013 | Seth et al. |
| 8,518,908 B2 | 8/2013 | Hrdlicka et al. |
| 8,530,640 B2 | 9/2013 | Seth et al. |
| 8,541,562 B2 | 9/2013 | Obika et al. |
| 8,546,556 B2 | 10/2013 | Seth et al. |
| 8,592,156 B2 | 11/2013 | Liu et al. |
| 8,637,478 B2 | 1/2014 | Bennett |
| RE44,779 E | 2/2014 | Imanishi et al. |
| 8,653,252 B2 | 2/2014 | Elmen et al. |
| 8,673,560 B2 | 3/2014 | Leamon et al. |
| 8,680,254 B2 | 3/2014 | Lutz et al. |
| 8,691,783 B2 | 4/2014 | Thum et al. |
| 8,703,728 B2 | 4/2014 | Swayze et al. |
| 8,710,021 B2 | 4/2014 | Anro et al. |
| 8,735,366 B2 | 5/2014 | Bauer et al. |
| 8,748,089 B2 | 6/2014 | Kariko et al. |
| 8,779,118 B2 | 7/2014 | Allerson et al. |
| 8,796,437 B2 | 8/2014 | Swayze et al. |
| 8,809,516 B2 | 8/2014 | Manoharan et al. |
| 8,846,386 B2 | 9/2014 | Ambati et al. |
| 8,846,637 B2 | 9/2014 | Seth et al. |
| 8,846,639 B2 | 9/2014 | Swayze et al. |
| 8,846,885 B2 | 9/2014 | Hirai et al. |
| 8,895,722 B2 | 11/2014 | Iversen et al. |
| 8,957,040 B2 | 2/2015 | Bennett et al. |
| 8,957,200 B2 | 2/2015 | Seth et al. |
| 8,957,201 B2 | 2/2015 | Kaneko et al. |
| 9,005,906 B2 | 4/2015 | Swayze et al. |
| 9,006,194 B2 | 4/2015 | Katsikis et al. |
| 9,006,415 B2 | 4/2015 | Ren et al. |
| 9,012,139 B2 | 4/2015 | Collard et al. |
| 9,029,335 B2 | 5/2015 | Prakash et al. |
| 9,045,518 B2 | 6/2015 | Christensen et al. |
| 9,045,754 B2 | 6/2015 | Bhanot et al. |
| 9,057,066 B2 | 6/2015 | Hung et al. |
| 9,109,001 B2 | 8/2015 | Parsy et al. |
| 9,127,272 B2 | 9/2015 | Esau et al. |
| 9,127,276 B2 | 9/2015 | Prakash et al. |
| 9,156,873 B2 | 10/2015 | Prakash et al. |
| 9,157,081 B2 | 10/2015 | Bennett et al. |
| 9,181,549 B2 | 11/2015 | Prakash et al. |
| 9,187,515 B2 | 11/2015 | Mayes et al. |
| 9,192,621 B2 | 11/2015 | Mayes et al. |
| 9,193,752 B2 | 11/2015 | Migawa et al. |
| 9,193,969 B2 | 11/2015 | Montefeltro et al. |
| 9,211,300 B2 | 12/2015 | Mayes et al. |
| 9,217,147 B2 | 12/2015 | Singh et al. |
| 9,221,864 B2 | 12/2015 | Seth et al. |
| 9,243,245 B2 | 1/2016 | De Kimpe et al. |
| 9,290,534 B2 | 3/2016 | Seth et al. |
| 9,296,778 B2 | 3/2016 | Parsy et al. |
| 9,309,275 B2 | 4/2016 | Stewart et al. |
| 9,315,535 B2 | 4/2016 | Mitsuoka et al. |
| 9,334,495 B2 | 5/2016 | Khvorova et al. |
| 9,339,541 B2 | 5/2016 | Dousson et al. |
| 9,347,068 B2 | 5/2016 | Dhugga et al. |
| 9,359,445 B2 | 6/2016 | Finkbeiner et al. |
| 9,359,603 B2 | 6/2016 | Lutz et al. |
| 9,359,609 B2 | 6/2016 | Duffield et al. |
| 9,410,155 B2 | 8/2016 | Collard et al. |
| 9,428,534 B2 | 8/2016 | Christensen et al. |
| 9,447,166 B2 | 9/2016 | Ambati et al. |
| 9,453,261 B2 | 9/2016 | Lee et al. |
| 9,464,292 B2 | 10/2016 | Okumura et al. |
| 9,499,818 B2 | 11/2016 | Van Deutekom |
| 9,518,259 B2 | 12/2016 | Rigo et al. |
| 9,534,222 B2 | 1/2017 | Ambati et al. |
| 9,550,988 B2 | 1/2017 | Swayze |
| 9,714,422 B2 | 7/2017 | Vorechovsky et al. |
| 9,745,577 B2 | 8/2017 | Vorechovsky et al. |
| 9,771,579 B2 | 9/2017 | Collard et al. |
| 9,976,143 B2 | 5/2018 | Krainer et al. |
| 10,119,168 B2 | 11/2018 | Vaidya et al. |
| 10,196,639 B2 | 2/2019 | Vorechovsky et al. |
| 10,517,853 B2 | 12/2019 | Welch et al. |
| 10,583,128 B2 | 3/2020 | Collard et al. |
| 10,683,503 B2 | 6/2020 | Aznarez et al. |
| 2003/0148974 A1 | 8/2003 | Monia et al. |
| 2004/0063129 A1 | 4/2004 | Gaarde et al. |
| 2004/0219515 A1 | 11/2004 | Bentwich |
| 2005/0221354 A1 | 10/2005 | Mounts |
| 2005/0233327 A1 | 10/2005 | Welch et al. |
| 2006/0062790 A1 | 3/2006 | Reinhard et al. |
| 2006/0134670 A1 | 6/2006 | Piu |
| 2006/0166922 A1 | 7/2006 | Eichler et al. |
| 2007/0009899 A1 | 1/2007 | Mounts |
| 2007/0087376 A1 | 4/2007 | Potashkin |
| 2007/0249538 A1 | 10/2007 | Sazani et al. |
| 2008/0269123 A1 | 10/2008 | Li et al. |
| 2009/0186846 A1 | 7/2009 | Chabot et al. |
| 2009/0186946 A1 | 7/2009 | Taketomi et al. |

(56) References Cited

U.S. PATENT DOCUMENTS

| | | |
|---|---|---|
| 2009/0264353 A1 | 10/2009 | Orum et al. |
| 2009/0270332 A1 | 10/2009 | Bare et al. |
| 2010/0088778 A1 | 4/2010 | Mulley et al. |
| 2010/0150839 A1 | 6/2010 | Kelleher |
| 2010/0166784 A1 | 7/2010 | Murphy et al. |
| 2011/0124591 A1 | 5/2011 | Bennett |
| 2011/0229891 A1 | 9/2011 | Michaud et al. |
| 2012/0190728 A1 | 7/2012 | Bennett et al. |
| 2012/0252877 A1 | 10/2012 | Lo |
| 2013/0072671 A1 | 3/2013 | Van Deutekom |
| 2013/0096183 A1 | 4/2013 | Collard et al. |
| 2013/0109850 A1 | 5/2013 | Prakash et al. |
| 2013/0136732 A1 | 5/2013 | Wagner et al. |
| 2013/0184223 A1 | 7/2013 | Land et al. |
| 2013/0253036 A1 | 9/2013 | Collard et al. |
| 2013/0266560 A1 | 10/2013 | Demopulos et al. |
| 2013/0289092 A1 | 10/2013 | Rigo et al. |
| 2014/0011761 A1 | 1/2014 | Hotamisligil et al. |
| 2014/0128449 A1 | 5/2014 | Liu et al. |
| 2014/0186839 A1 | 7/2014 | Margulies et al. |
| 2014/0194610 A1 | 7/2014 | Verdine et al. |
| 2014/0235605 A1 | 8/2014 | Shiffman et al. |
| 2014/0309181 A1 | 10/2014 | Collard et al. |
| 2014/0336238 A1 | 11/2014 | Collin et al. |
| 2014/0343127 A1 | 11/2014 | Kammler |
| 2014/0349290 A1 | 11/2014 | Watnick et al. |
| 2014/0378526 A1 | 12/2014 | Rossi et al. |
| 2014/0378527 A1 | 12/2014 | Van Deutekom |
| 2014/0378533 A1 | 12/2014 | Freier |
| 2015/0004217 A1 | 1/2015 | Guild et al. |
| 2015/0018540 A1 | 1/2015 | Prakash et al. |
| 2015/0184153 A1 | 7/2015 | Freier et al. |
| 2015/0211006 A1 | 7/2015 | Butler et al. |
| 2015/0211010 A1 | 7/2015 | Kerem et al. |
| 2015/0232845 A1 | 8/2015 | Ozsolak |
| 2015/0232858 A1 | 8/2015 | Ozsolak |
| 2015/0238516 A1 | 8/2015 | Dowdy et al. |
| 2015/0267192 A1 | 9/2015 | Heartlein et al. |
| 2015/0291957 A1 | 10/2015 | Smith |
| 2015/0329918 A1 | 11/2015 | Kang et al. |
| 2015/0337310 A1 | 11/2015 | Walker et al. |
| 2015/0361497 A1 | 12/2015 | Rose |
| 2016/0017322 A1 | 1/2016 | Vorechovsky et al. |
| 2016/0024500 A1 | 1/2016 | Popplewell et al. |
| 2016/0046935 A1 | 2/2016 | Bentwich et al. |
| 2016/0122767 A1 | 5/2016 | Gouya et al. |
| 2016/0201063 A1 | 7/2016 | Ozsolak |
| 2016/0201064 A1 | 7/2016 | Ozsolak |
| 2016/0208264 A1 | 7/2016 | Wilton et al. |
| 2016/0215291 A1 | 7/2016 | Garcia et al. |
| 2016/0244762 A1 | 8/2016 | Vorechovsky et al. |
| 2016/0244767 A1 | 8/2016 | Hastings |
| 2016/0298121 A1 | 10/2016 | Krainer et al. |
| 2017/0044540 A1 | 2/2017 | Sætrom et al. |
| 2017/0159049 A9 | 6/2017 | Krainer et al. |
| 2017/0240904 A1 | 8/2017 | Tallent et al. |
| 2018/0002694 A1 | 1/2018 | Vorechovsky et al. |
| 2018/0296501 A1 | 10/2018 | During |
| 2018/0362987 A1 | 12/2018 | Krainer et al. |
| 2019/0024118 A1 | 1/2019 | Tagliatela et al. |
| 2019/0024119 A1 | 1/2019 | Tagliatela et al. |
| 2019/0024120 A1 | 1/2019 | Tagliatela et al. |
| 2019/0024121 A1 | 1/2019 | Tagliatela et al. |
| 2019/0070213 A1 | 3/2019 | Aznarez et al. |
| 2019/0192691 A1 | 6/2019 | Barrett et al. |
| 2019/0218255 A1 | 7/2019 | Chung et al. |
| 2019/0225939 A1 | 7/2019 | Chambers et al. |
| 2019/0264211 A1 | 8/2019 | Vorechovsky et al. |
| 2020/0024603 A1 | 1/2020 | Aznarez et al. |
| 2020/0085838 A1 | 3/2020 | Martinez Botella et al. |
| 2020/0101174 A1 | 4/2020 | Coller et al. |

FOREIGN PATENT DOCUMENTS

| | | |
|---|---|---|
| EP | 1201678 B1 | 9/2004 |
| EP | 1409497 B1 | 1/2005 |
| EP | 1007714 B1 | 12/2005 |
| EP | 1334109 B1 | 5/2006 |
| EP | 1178999 B1 | 3/2007 |
| EP | 1203827 B1 | 5/2007 |
| EP | 1501848 B1 | 8/2007 |
| EP | 1569661 B1 | 9/2009 |
| EP | 1161439 B1 | 4/2010 |
| EP | 1984381 B1 | 9/2010 |
| EP | 1013661 B1 | 1/2012 |
| EP | 2092065 B1 | 1/2012 |
| EP | 2099461 B1 | 3/2012 |
| EP | 2170917 B1 | 6/2012 |
| EP | 2066684 B1 | 7/2012 |
| EP | 2284269 A3 | 8/2012 |
| EP | 2356129 B1 | 4/2013 |
| EP | 2376516 B1 | 4/2013 |
| EP | 2114981 B1 | 5/2013 |
| EP | 2149605 B1 | 7/2013 |
| EP | 2285819 B1 | 10/2013 |
| EP | 2161038 B1 | 12/2013 |
| EP | 1562971 B1 | 2/2014 |
| EP | 2295441 B1 | 5/2014 |
| EP | 2314594 B1 | 7/2014 |
| EP | 2410053 B1 | 10/2014 |
| EP | 2176280 B2 | 6/2015 |
| EP | 2361921 B1 | 6/2015 |
| EP | 2462153 B1 | 7/2015 |
| EP | 1015469 B2 | 11/2015 |
| EP | 2173760 B2 | 11/2015 |
| EP | 1937312 B1 | 6/2016 |
| EP | 2141233 B1 | 10/2016 |
| EP | 2410054 B1 | 1/2017 |
| EP | 3329909 A1 | 6/2018 |
| EP | 2753317 B1 | 2/2020 |
| GB | 2546719 A | 8/2017 |
| WO | WO-9402501 A1 | 2/1994 |
| WO | WO-9426887 A1 | 11/1994 |
| WO | WO-2005049651 A2 | 6/2005 |
| WO | WO-2006107846 A2 | 10/2006 |
| WO | WO-2007002390 A2 | 1/2007 |
| WO | WO-2007048628 A2 | 5/2007 |
| WO | WO-2007048629 A2 | 5/2007 |
| WO | WO-2007056113 A2 | 5/2007 |
| WO | WO-2007002390 A3 | 11/2007 |
| WO | WO-2009084472 A1 | 7/2009 |
| WO | WO-2010148249 A1 | 12/2010 |
| WO | WO-2011057350 A1 | 5/2011 |
| WO | WO-2011163499 A2 | 12/2011 |
| WO | WO-2012168435 A1 | 12/2012 |
| WO | WO-2012178146 A1 | 12/2012 |
| WO | WO-2013036105 A1 | 3/2013 |
| WO | WO-2013081755 A1 | 6/2013 |
| WO | WO-2013106770 A1 | 7/2013 |
| WO | WO-2013119916 A2 | 8/2013 |
| WO | WO-2013119916 A3 | 10/2013 |
| WO | WO-2014012081 A2 | 1/2014 |
| WO | WO-201428459 A1 | 2/2014 |
| WO | WO-2014028459 A1 | 2/2014 |
| WO | WO-2014031575 A1 | 2/2014 |
| WO | WO-2014049536 A2 | 4/2014 |
| WO | WO-2014121287 A2 | 8/2014 |
| WO | WO-2014172698 A1 | 10/2014 |
| WO | WO-2014201413 A1 | 12/2014 |
| WO | WO-2014209841 A2 | 12/2014 |
| WO | WO-2015024876 A2 | 2/2015 |
| WO | WO-2015035091 A1 | 3/2015 |
| WO | WO-2015024876 A3 | 7/2015 |
| WO | WO-2014209841 A3 | 10/2015 |
| WO | WO-2015190922 A1 | 12/2015 |
| WO | WO-2015193651 A1 | 12/2015 |
| WO | WO-2015198054 A1 | 12/2015 |
| WO | WO-2016027168 A2 | 2/2016 |
| WO | WO-2015193651 A4 | 3/2016 |
| WO | WO-2016027168 A3 | 4/2016 |
| WO | WO-2016054615 A2 | 4/2016 |

(56) References Cited

FOREIGN PATENT DOCUMENTS

| WO | WO-2016061509 A1 | 4/2016 |
|---|---|---|
| WO | WO-2016054615 A3 | 5/2016 |
| WO | WO-2016077837 A1 | 5/2016 |
| WO | WO-2016087842 A1 | 6/2016 |
| WO | WO-2016118697 A1 | 7/2016 |
| WO | WO-2016128343 A1 | 8/2016 |
| WO | WO-2016138534 A2 | 9/2016 |
| WO | WO-2016161429 A1 | 10/2016 |
| WO | WO-2016196386 A1 | 12/2016 |
| WO | WO-2017053982 A1 | 3/2017 |
| WO | WO-2017060731 A1 | 4/2017 |
| WO | WO-2017106210 A1 | 6/2017 |
| WO | WO-2017106211 A1 | 6/2017 |
| WO | WO-2017106283 A1 | 6/2017 |
| WO | WO-2017106292 A1 | 6/2017 |
| WO | WO-2017106364 A2 | 6/2017 |
| WO | WO-2017106370 A1 | 6/2017 |
| WO | WO-2017106375 A1 | 6/2017 |
| WO | WO-2017106377 A1 | 6/2017 |
| WO | WO-2017106382 A1 | 6/2017 |
| WO | WO-2017106364 A3 | 7/2017 |
| WO | WO-2018007980 A1 | 1/2018 |
| WO | WO-2018187363 A1 | 10/2018 |
| WO | WO-2018191482 A2 | 10/2018 |
| WO | WO-2018206924 A1 | 11/2018 |
| WO | WO-2019040923 A1 | 2/2019 |
| WO | WO-2019084050 A1 | 5/2019 |
| WO | WO-2019109051 A1 | 6/2019 |
| WO | WO-2019191341 A1 | 10/2019 |
| WO | WO-2019199867 A1 | 10/2019 |
| WO | WO-2019227096 A1 | 11/2019 |
| WO | WO-2019236750 A2 | 12/2019 |
| WO | WO-2019243430 A1 | 12/2019 |
| WO | WO-2020041348 A1 | 2/2020 |
| WO | WO-2020176776 A1 | 9/2020 |

OTHER PUBLICATIONS

EP 16876621.0 Extended European Search Report and Search Opinion dated Mar. 7, 2019.
EP16876606.1 Extended Search Report dated May 24, 2019.
Guy et al. A mouse Mecp2-null mutation causes neurological symptoms that mimic Rett syndrome. Nat Genet 27:322-326 (2001).
International Search Report and Written Opinion dated Mar. 28, 2019 for PCT/US2018/057165.
Itoh et al. Methyl CpG-binding Protein Isoform MeCP2_e2 Is Dispensable for Rett Syndrome Phenotypes but Essential for Embryo Viability and Placenta Development. J Biol Chem 287:13859-13867 (2012).
Kach et al. A novel antisense oligonucleotide approach to treat eye diseases by increasing target gene expression. No. 3423-A0194 ARVO Poster Apr. 19, 2019 (1 pg.).
Knudsen et al. Increased skewing of X chromosome inactivation in Rett syndrome patients and their mothers. Eur J Hum Genet 14:1189-1194(2006).
Kriaucionis et al. The major form of MeCP has a novel N-terminus generated by alternative splicing. Nucleic Acids Res 32:1818-1823 (2004).
Krishnaraj et al. RettBASE: Rett syndrome database update. Hum Mutat 38:922-931 (2017).
Liu et al. Alternative splicing and retinal degeneration. Clinical Genetics 84(2):142-149 (2013).
Long et al. Correction of diverse muscular dystrophy mutations in human engineered heart muscle by single-site genome editing. Sci Adv 4:eaap9004 (2018).
McKie et al. Mutations in the pre-mRNA splicing factor gene PRPC8 in autosomal dominant retinitis pigmentosa (RP13). Human Molecular Genetics 10(15):1555-1562 (2001).
Mnatzakanian et al. A previously unidentified MECP2 open reading frame defines a new protein isoform relevant to Rett syndrome. Nat Genet 36:339-341 (2004).

Database Geneseq [Online], Nov. 13, 2008 (Nov. 13, 2008), Dual label detection probe, QF probe 1, 5.3.11, XP055572852, retrieved from EBI Accession No. GSN:ARK21623.
Ramocki et al. The MECP2 duplication syndrome. Am J Med Genet A 152A:1079-1088 (2010).
Rangasamy et al. Reduced neuronal size and mTOR pathway activity in the Mecp2 A140V Rett syndrome mouse model. F1000research 5:2269 (2016).
Schanen et al. A Severely Affected Male Born into a Rett Syndrome Kindred Supports X-Linked Inheritance and Allows Extension of the Exclusion Map. Am J Hum Genetics 63:267-269 (1998).
Stein et al. FDA-Approved Oligonucleotide Therapies in 2017. Mol Ther 25:1069-1075 (2017).
Supplementary European Search Report dated Apr. 18, 2019 for EP16876615.2.
Takahashi et al. Skewed X chromosome inactivation failed to explain the normal phenotype of a carrier female with MECP2 mutation resulting in Rett syndrome. Clin Genet 73:257-261 (2008).
Tillotson et al. Radically truncated MeCP2 rescues Rett syndrome-like neurological defects. Nature 550:398 (2017).
Yang et al. Biophysical analysis and small-angle X-ray scattering-derived structures of MeCP2-nucleosome complexes. Nucleic Acids Res 39:4122-4135 (2011).
Young et al. 915—a GABA-Selective AAV Vector-Based Approach to Up-Regulate Endogenous Scn1a Expression reverses key Phenotypes in a Mouse Model of Dravet Syndrome. 22nd Annual Meeting American Society of Gene & Cell Therapy. Washington, D.C. Apr. 29-May 2, 2019 (Abstract).
EP16781187.6 Office Action dated May 20, 2019.
EP16876499.1 Extended Search Report dated Jun. 14, 2019.
Li et al. JAG1 Mutation Spectrum and Origin in Chinese Children with Clinical Features of Alagille Syndrome. PLoS One 10(6):e0130355 (2015).
Pilia et al. Jagged-1 mutation analysis in Italian Alagille syndrome patients. Hum Mut 14(5):394-400 (1999).
Spinner et al. Jagged1 mutations in alagille syndrome. Hum Mutat 17(1):18-33 (2001).
Yamamoto et al. Mib-Jag1-Notch signalling regulates patterning and structural roles of the notochord by controlling cell-fate decisions. Development 137(15):2527-2537 (2010).
Aartsma-Rus, et al. Antisense-mediated exon skipping: a versatile tool with therapeutic and research applications.RNA. Oct. 2007;13(10):1609-24. Epub Aug. 7, 2007.
Aizer AA, et al. Lack of reduction in racial disparities in cancer-specific mortality over a 20-year period. Cancer. 2014;120:1532-9.
Altschul SF et al.Basic local alignment search tool. J. Mol. Biol., vol. 215, No. 3, pp. 403-410, (Oct. 5, 1990).
Aly, et al. Extreme genetic risk for type 1A diabetes. Proc Natl Acad Sci U S A. Sep. 19, 2006;103(38):14074-9. Epub Sep. 11, 2006.
Amarnath, S. et al. The PDL1-PD1 Axis Converts Human TH1 Cells into Regulatory T Cells. Science Translational Medicine, vol. 3, No. 111, pp. 1-13. (Nov. 30, 2011).
Anders S. et al. Detecting differential usage of exons from RNA-seq data. Genome Res. 2012;22(10):2008-17. Epub Jun. 23, 2012.doi: gr.133744.111 [pii] 10.1101/gr.133744.111. PubMed PMID: 22722343.
Au, K.S. et al. Molecular Genetic Basis of Tuberous Sclerosis Complex: From Bench to Bedside.Journal of Child Neurology. vol. 19, No. 9 (Sep. 2004).
Aznarez, et al. TANGO-Targeted augmentation of nuclear gene output—for the treatment of genetic diseases [abstract]. In: 2018 Annual Meeting Abstract of the American Society of Gene and Cell Therapy; May 16-19, 2018; Chicago, IL; 2018. Abstract No. 304.
Bakkenist CJ, Kastan MB. DNA damage activates ATM through intermolecular autophosphorylation and dimer dissociation. Nature. 2003;421(6922):499-506. doi: 10.1038/nature01368. PubMed PMID: 12556884.
Balagurumoorthy, et al. Hairpin and parallel quartet structures for telomeric sequences. Nucleic Acids Res. Aug. 11, 1992;20(15):4061-7.
Balkwill, et al. Repression of translation of human estrogen receptor alpha by G-quadruplex formation. Biochemistry. Dec. 8, 2009;48(48):11487-95. doi: 10.1021/bi901420k.

(56) References Cited

OTHER PUBLICATIONS

Barratt, et al. Remapping the insulin gene/IDDM2 locus in type 1 diabetes. Diabetes. Jul. 2004;53(7):1884-9.
Bassi et al. A novel mutation in the ATP1A2 gene causes alternating hemiplegia of childhood. J. Med. Genet. 41:621-628 (2004).
Battistini et al. A new CACNA1A gene mutation in acetazolamide-responsive familial hemiplegic migraine and ataxia.Neurology, vol. 53, No. 1, pp. 38-43 (Jul. 13, 1999).
Baughan, et al. Delivery of bifunctional RNAs that target an intronic repressor and increase SMN levels in an animal model of spinal muscular atrophy. Hum Mol Genet. May 1, 2009;18(9):1600-11. doi: 10.1093/hmg/ddp076. Epub Feb. 19, 2009.
Bauman et al. Therapeutic potential of splice-switching oligonucleotides. Oligonucleotides 19.1 (2009): 1-13.
Beaudoin, et al. 5'-UTR G-quadruplex structures acting as translational repressors. Nucleic Acids Res. Nov. 2010;38(20):7022-36. doi: 10.1093/nar/gkq557. Epub Jun. 22, 2010.
Beli P, et al., Proteomic investigations reveal a role for RNA processing factor THRAP3 in the DNA damage response. Mol Cell. 2012;46(2):212-25. doi: 10.1016/j.molcel.2012.01.026. PubMed PMID: 22424773; PubMed Central PMCID: PMC3565437.
Berge, SM et al. Pharmaceutical Salts Journal of Pharmaceutical Sciences, vol. 66, No. 1, pp. 1-19 (1977).
Berger, W. et al. The molecular basis of human retinal and vitreoretinal diseases. Progress in Retinal and Eye Research . vol. 29, pp. 335-375 (2010).
Bethke L, et al. Comprehensive analysis of the role of DNA repair gene polymorphisms on risk of glioma. Hum Mol Genet. 2008;17(6):800-5. Epub 2007/12/01.doi: ddm351 [pii] 10.1093/hmg/ddm351. PubMed PMID: 18048407.
Bicknell, et al. Introns in UTRs: why we should stop ignoring them. Bioessays. Dec. 2012;34(12):1025-34. doi: 10.1002/bies. 201200073. Epub Oct. 26, 2012.
Blencowe, Benjamin. Reflections for the 20th anniversary issue of RNA journal.RNA Journal, vol. 21, No. 4, pp. 573-575 (2015).
Blencowe BJ. Splicing regulation: the cell cycle connection. Curr Biol. 2003;13(4):R149-51. PubMed PMID: 12593819.
Bonnen, P.E., et al. Haplotypes at ATM identify coding-sequence variation and indicate a region of extensive linkage disequilibrium. Am J Hum Genet. 2000;67(6):1437-51. Epub Nov. 15, 2000.doi: S0002-9297(07)63213-3 [pii] 10.1086/316908. PubMed PMID: 11078475.
Boothby, T. et al. Removal of Retained Introns Regulates Translation in the Rapidly Developing Gametophyte of Marsilea vestita. Developmental Cell vol. 24, pp. 517-529, (Mar. 11, 2013).
Booy, et al. The RNA helicase RHAU (DHX36) unwinds a G4-quadruplex in human telomerase RNA and promotes the formation of the P1 helix template boundary. Nucleic Acids Res. May 2012;40(9):4110-24. doi: 10.1093/nar/gkr1306. Epub Jan. 11, 2012.
Boutz, et al. Detained introns are a novel, widespread class of post-transcriptionally spliced introns. Genes Dev. Jan. 1, 2015;29(1):63-80. doi: 10.1101/gad.247361.114.
Braunschweig, et al. Widespread intron retention in mammals functionally tunes transcriptomes. Widespread intron retention in mammals functionally tunes transcriptomes. Genome Res. Nov. 2014;24(11):1774-86. doi: 10.1101/gr.177790.114. Epub Sep. 25, 2014.
Bravo-Gil, et al., Improving the management of Inherited Retinal Dystrophies by targeted sequencing of a population-specific gene panel, Scientific Reports, 6:23910, 10 pages.
Brooks, A.N., et al. A pan-cancer analysis of transcriptome changes associated with somatic mutations in U2AF1 reveals commonly altered splicing events. PLoS One. 2014; 9(1):e87361. Epub Feb. 6, 2014.doi: 10.1371/journal.pone.0087361 PONE-D-13-26905 [pii]. PubMed PMID: 24498085.
Buchman, et al. Comparison of intron-dependent and intron-independent gene expression. Mol Cell Biol. Oct. 1988;8(10):4395-405.
Buckley, P.T. et al. Cytoplasmic intron retention, function, splicing, and the sentinel RNA hypothesis.WIREs RNA, vol. 5, pp. 223-2330 (Mar./Apr. 2014).
Bugaut, et al. 5'-UTR RNA G-quadruplexes: translation regulation and targeting. Nucleic Acids Res. Jun. 2012;40(11):4727-41. doi: 10.1093/nar/gks068. Epub Feb. 20, 2012.
Bugaut, et al. An RNA hairpin to G-quadruplex conformational transition. J Am Chem Soc. Dec. 12, 2012;134(49):19953-6. doi: 10.1021/ja308665g. Epub Nov. 29, 2012.
Buratti, et al. DBASS3 and DBASS5: databases of aberrant 3'- and 5'-splice sites. Nucleic Acids Res. Jan. 2011;39(Database issue):D86-91. doi: 10.1093/nar/gkq887. Epub Oct. 6, 2010.
Buratti, et al. RNA folding affects the recruitment of SR proteins by mouse and human polypurinic enhancer elements in the fibronectin EDA exon. Mol Cell Biol. Feb. 2004;24(3):1387-400.
Burnette et al. Subdivision of large introns in *Drosophila* by recursive splicing at non-exonic elements. Genetics (2005).
Burns, CG, et al. Connections between pre-mRNA processing and regulation of the eukaryotic cell cycle. Front Horm Res. 1999; 25:59-82.
Busslinger, et al. β+ Thalassemia: Aberrant splicing results from a single point mutation in an intron. Cell 27.2 (1981): 289-298.
Callis, et al. Introns increase gene expression in cultured maize cells. Genes Dev. Dec. 1987;1(10):1183-200.
Catterall, et al. Nav1.1 channels and epilepsy. J Physiol. Jun. 1, 2010;588(Pt 11):1849-59.
Cavaloc, et al. The splicing factors 9G8 and SRp20 transactivate splicing through different and specific enhancers. RNA. Mar. 1999;5(3):468-83.
Cazzola, et al. Translational pathophysiology: a novel molecular mechanism of human disease. Blood. Jun. 1, 2000;95(11):3280-8.
Chambers, A.L., et al. The INO80 chromatin remodeling complex prevents polyploidy and maintains normal chromatin structure at centromeres. Genes Dev. 2012; 26(23):2590-603. Epub Dec. 5, 2012.doi: 26/23/2590 [pii] 10.1101/gad.199976.112. PubMed PMID: 23207916.
Chen, M.S., et al. Chk1 kinase negatively regulates mitotic function of Cdc25A phosphatase through 14-3-3 binding. Mol Cell Biol. 2003; 23(21):7488-97. PubMed PMID: 14559997; PubMed Central PMCID: PMC207598.
Chen, T., et al. A functional single nucleotide polymorphism in promoter of ATM is associated with longevity. Mech Ageing Dev. 2010; 131:636-40.
Choi, HH, et al. CHK2 kinase promotes pre-mRNA splicing via phosphorylating CDK11p110. Oncogene. 2014; 33:108-15.
Colla, S., et al. Telomere dysfunction drives aberrant hematopoietic differentiation and myelodysplastic syndrome. Cancer Cell. 2015; 27(5):644-57. doi: 10.1016/j.ccell.2015.04.007. PubMed PMID: 25965571.
Collie, et al. The application of DNA and RNA G-quadruplexes to therapeutic medicines. Chem Soc Rev. Dec. 2011;40(12):5867-92. doi: 10.1039/c1cs15067g. Epub Jul. 25, 2011.
Consortium. TGP. An integrated map of genetic variation from 1,092 human genomes. Nature (London). 2012; 491:56-65.
Co-pending U.S. Appl. No. 16/213,535, filed Dec. 7, 2018.
Corallini et al. Transcriptional and Posttranscriptional Regulation of the CTNS Gene. Pediatric Research 70(2):130-135 (Aug. 2011).
Corey, S.J., et al. A non-classical translocation involving 17q12 (retinoic acid receptor alpha) in acute promyelocytic leukemia (APML) with atypical features. Leukemia. 1994; 8(8):1350-3. PubMed PMID: 8057672.
Corvelo, A., et al. Genome-wide association between branch point properties and alternative splicing. PLoS Comput Biol. 2010; 6(11):e1001016. Epub Dec. 3, 2010.doi: 10.1371/journal.pcbi. 1001016. PubMed PMID: 21124863.
Coulombe-Huntington J., et al. Fine-Scale Variation and Genetic Determinants of Alternative Splicing across Individuals. PLoS Genet. 2009; 5(12):e1000766. Epub Dec. 17, 2009.doi: 10.1371/journal.pgen.1000766. PubMed PMID: 20011102.
Coutinho, G., et al. Functional significance of a deep intronic mutation in the ATM gene and evidence for an alternative exon 28a. Hum Mutat. 2005; 25(2):118-24. Epub Jan. 12, 2005.doi: 10.1002/humu.20170. PubMed PMID: 15643608.

(56) References Cited

OTHER PUBLICATIONS

Creacy, et al. G4 resolvase 1 binds both DNA and RNA tetramolecular quadruplex with high affinity and is the major source of tetramolecular quadruplex G4-DNA and G4-RNA resolving activity in HeLa cell lysates. J Biol Chem. Dec. 12, 2008;283(50):34626-34. doi: 10.1074/jbc.M806277200. Epub Oct. 7, 2008.

Culler, et al. Functional selection and systematic analysis of intronic splicing elements identify active sequence motifs and associated splicing factors. Nucleic Acids Res. Aug. 2010;38(15):5152-65. doi: 10.1093/nar/gkq248. Epub Apr. 12, 2010.

Davies, et al. A genome-wide search for human type 1 diabetes susceptibility genes. Nature. Sep. 8, 1994;371(6493):130-6.

Decorsiere, et al. Essential role for the interaction between hnRNP H/F and a G quadruplex in maintaining p53 pre-mRNA 3'-end processing and function during DNA damage. Genes Dev. Feb. 1, 2011;25(3):220-5. doi: 10.1101/gad.607011.

Dedic, T. et al. Alagille Syndrome Mimicking Biliary Atresia in Early Infancy, PLOS OONE, 10(11):e0143939: pp. 1-7 (Nov. 20, 2015).

Deere, J. et al. AntisensePhosphorodiamidate Morpholino OligomerLengthand TargetPositionEffects on Gene-SpecificInhibitionin *Escherichia coli*. Antimicrobial Agents AndChemotherapy, vol. 49, No. 1, p. 249-255(Jan. 2005.

Derecka, et al. Occurrence of a quadruplex motif in a unique insert within exon C of the bovine estrogen receptor alpha gene (ESR1). Biochemistry. Sep. 7, 2010;49(35):7625-33. doi: 10.1021/bi100804f.

Dias, N. et al. Antisense oligonucleotides: basic concepts and mechanisms Mol. Cancer Ther. vol. 1, pp. 347-355, (Mar. 2002).

Didiot, et al. The G-quartet containing FMRP binding site in FMR1 mRNA is a potent exonic splicing enhancer. Nucleic Acids Res. Sep. 2008;36(15):4902-12. doi: 10.1093/nar/gkn472. Epub Jul. 24, 2008.

Ding, H. et al. DeliveringPD-1 inhibitory signal concomitant with blocking ICOS co-stimulation suppresses lupus-like syndrome in autoimmune BXSB mice.Clinical Immunology, vol. 118, pp. 258-267, (2006).

Divina, P. et al. Ab initio prediction of cryptic splice-site activation and exon skipping. Eur J Hum Genet. 2009; 17:759-65.

Dominski, et al. Restoration of correct splicing in thalassemic pre-mRNA by antisense oligonucleotides. Proc Natl Acad Sci U S A. Sep. 15, 1993;90(18):8673-7.

Dredge, et al. NeuN/Rbfox3 Nuclear and Cytoplasmic Isoforms Differentially Regulate Alternative Splicing and Nonsense-Mediated Decay of Rbfox2. PLoS One. 2011; 6(6): e21585.

Du, et al. Correction of prototypic ATM splicing mutations and aberrant ATM function with antisense morpholino oligonucleotides. Proc Natl Acad Sci U S A. Apr. 3, 2007;104(14):6007-12. Epub Mar. 26, 2007.

Ducros et al.Recurrence of the T666M calcium channel CACNA1A gene mutation in familial hemiplegic migraine with progressive cerebellar ataxia.Am J Hum Genet. vol. 64, No. 1, pp. 89-98 (Jan. 1999).

Duryagina R, et al. Overexpression of Jagged-1 and its intracellular domain in human mesenchymal stromal cells differentially affect the interaction with hematopoietic stem and progenitor cells.Stem Cells Dev. vol. 22, No. 20, pp. 2736-2750 (2013).

Dutertre, M., et al. et al. DNA damage: RNA-binding proteins protect from near and far. Trends Biochem Sci. 2014; 39(3):141-9. Epub Feb. 19, 2014.doi: S0968-0004(14)00015-2 [pii] 10.1016/j.tibs.2014.01.003. PubMed PMID: 24534650.

Eddy, et al. G4 motifs correlate with promoter-proximal transcriptional pausing in human genes. Nucleic Acids Res. Jul. 2011;39(12):4975-83. doi: 10.1093/nar/gkr079. Epub Mar. 3, 2011.

El Bougrini, J., et al. PML positively regulates interferon gamma signaling. Biochimie. 2011; 93(3):389-98. doi: 10.1016/j.biochi.2010.11.005. PubMed PMID: 21115099.

Emerick, et al. Multivariate analysis and visualization of splicing correlations in single-gene transcriptomes. BMC Bioinformatics. Jan. 18, 2007;8:16.

EP 15846242.4 Partial Supplementary Search Report and Search Opinion dated May 2, 2018.

EP15729929.8 Office Action dated Dec. 22, 2017.

EP15729929.8 Office Action dated Oct. 30, 2018.

EP15846242.4 Extended European Search Report dated Aug. 21, 2018.

Fairbrother, W.G., et al. Predictive identification of exonic splicing enhancers in human genes. Science. 2002; 297(5583):1007-13. PubMed PMID: 12114529.

Fededa, et al. A polar mechanism coordinates different regions of alternative splicing within a single gene. Mol Cell. Aug. 5, 2005;19(3):393-404.

Ferreira, P.G., et al. Transcriptome characterization by RNA sequencing identifies a major molecular and clinical subdivision in chronic lymphocytic leukemia. Genome Res. 2014; 24:212-26.

Fletcher, Sue et al. Antisense suppression of donor splice site mutations in the dystrophin gene transcript.Molecular Genetics & Genomic Medicine, vol. 1, No. 3, pp. 162-173, Jun. 13, 2013.

Fred, et al. The human insulin mRNA is partly translated via a cap- and eIF4A-independent mechanism. Biochem Biophys Res Commun. Sep. 9, 2011;412(4):693-8. doi: 10.1016/j.bbrc.2011.08.030. Epub Aug. 16, 2011.

Friedman, KJ et al. Correction of aberrant splicing of the cystic fibrosis transmembrane conductance regulator (CFTR) gene by antisense oligonucleotides. J Biol Chem. Dec. 17, 1999;274(51):36193-36199.

Friend, KL et al. Detection of a novel missense mutation and second recurrent mutation in the CACNA1A gene in individuals with EA-2 and FHM. Hum Genet. vol. 105(3):261-5 (Sep. 1999).

Furukawa & Kish 2008, GeneReviews Pagon Ra et al. eds. Univ. of WA Seattle, NCBI Bookshelf ID NBK1437.

Galante, et al. Detection and evaluation of intron retention events in the human transcriptome. RNA. May 2004;10(5):757-65.

Garner, et al. Selectivity of small molecule ligands for parallel and anti-parallel DNA G-quadruplex structures. Org Biomol Chem. Oct. 21, 2009;7(20):4194-200. doi: 10.1039/b910505k. Epub Aug. 14, 2009.

Geary et al. Absolute Bioavailability of 29-O-(2-Methoxyethyl)-Modified Antisense Oligonucleotides following Intraduodenal Instillation in Rats. J Pharmacal Exp Ther. vol. 296, No. 3, pp. 898-904 (Mar. 2001).

Geary, RS, et al., Pharmacokinetic properties of 2'-O-(2-methoxyethyl)-modified oligonucleotide analogs in ratsJ Pharmacal Exp Ther. vol. 296, No. 3, pp. 890-897 (Mar. 2001).

Gianchecchi, E. et al. Recent insights into the role of the PD-1/PD-L1 pathway in immunological tolerance and autoimmunity Autoimmunity Reviews vol. 12, pp. 1091-1100, (2013).

Gibson, G. Hints of hidden heritability in GWAS. Nat Genet. 2010; 42(7):558-60. Epub Jun. 29, 2010.doi: ng0710-558 [pii] 10.1038/ng0710-558. PubMed PMID: 20581876.

Gohring, J. et al. Imaging of Endogenous MessengerRNA Splice Variants in Living Cells Reveals Nuclear Retention of Transcripts Inaccessible to Nonsense-Mediated Decay in *Arabidopsis*.The Plant Cell.vol. 26, pp. 754-764.(Feb. 2014).

Gomez, et al. Telomerase downregulation induced by the G-quadruplex ligand 12459 in A549 cells is mediated by hTERT RNA alternative splicing. Nucleic Acids Res. Jan. 16, 2004;32(1):371-9. Print 2004.

Goncharova et al. Tuberin regulates p70 S6 kinase activation and ribosomal protein S6 phosphorylation. A role for the TSC2 tumor suppressor gene in pulmonary lymphangioleiomyomatosis (LAM). J. Biol. Chem. (Aug. 23, 2002) 277(34);30958-67. EPub Jun. 3, 2002.

Gonzalez-Santos, et al., Mutation in the splicing factor Hprp3p linked to retinitis pigmentosa impairs interactions within the U4/U6 snRNP pigmentosa impairs interactions within the U4/U6 snRNP complex, PubMed Central Canada , Author Manuscript, 29 pages.

Goyenvalie, et al. Therapeutic approaches to muscular dystrophy. Hum Mol Genet. Apr. 15, 2011;20(R1):R69-78. doi: 10.1093/hmg/ddr105. Epub Mar. 24, 2011.

Gozani, O., et al. A potential role for U2AF-SAP 155 interactions in recruiting U2 snRNP to the branch site. Mol Cell Biol. 1998; 18(8):4752-60. PubMed PMID: 9671485.

(56) References Cited

OTHER PUBLICATIONS

Graveley, B.R. The haplo-spliceo-transcriptome: common variations in alternative splicing in the human population. Trends Genet. 2008; 24(1):5-7. Epub Dec. 7, 2007.doi: S0168-9525(07)00349-6 [pii] 10.1016/j.tig.2007.10.004. PubMed PMID: 18054116.

Gutell, R.R., et al. A story: unpaired adenosine bases in ribosomal RNAs. J Mol Biol. 2000; 304(3):335-54. Epub Nov. 25, 2000.doi: 10.1006/jmbi.2000.4172 S0022-2836(00)94172-X [pii]. PubMed PMID: 11090278.

Guth, S., et al. Dual function for U2AF(35) in AG-dependent pre-mRNA splicing. Mol Cell Biol. 2001;21(22):7673-81. PubMed PMID: 11604503.

Hai, et al. A G-tract element in apoptotic agents-induced alternative splicing. Nucleic Acids Res. Jun. 2008;36(10):3320-31. doi: 10.1093/nar/gkn207. Epub Apr. 24, 2008.

Hamdan, F. et al. Mutations in SYNGAP1 in Autosomal Nonsyndromic Mental Retardation.The New England Journal of Medicine.N.Engl. Med. vol. 360, No. 6, pp. 599, (Feb. 5, 2009).

Hamdan, F. F. et al. De Novo SYNGAP1 Mutations in Nonsyndromic Intellectual Disability and Autism, Biol. Psychiatry, 69:898-901 (2011).

Han, et al. TANGO-Targeted augmentation of nuclear gene output for the treatment of genetic diseases. Poster session presented at the American Society of Gene and Cell Therapy, Chicago, IL. (May 2018).

Hargous, et al. Molecular basis of RNA recognition and TAP binding by the SR proteins SRp20 and 9G8. EMBO J. Nov. 1, 2006;25(21):5126-37. Epub Oct. 12, 2006.

Harkin, et al. The spectrum of SCN1A-related infantile epileptic encephalopathies. Brain. Mar. 2007;130(Pt 3):843-52.

Hastings, M.L., et al. Control of pre-mRNA splicing by the general splicing factors PUF60 and U2AF. PLoS ONE. 2007;2:e538. PubMed PMID: 17579712.

He, Y.H., et al. Association of the insulin-like growth factor binding protein 3 (IGFBP-3) polymorphism with longevity in Chinese nonagenarians and centenarians. Aging (Milano). 2014;6:944-56.

Hegele, et al. Dynamic protein-protein interaction wiring of the human spliceosome. Mol Cell. Feb. 24, 2012;45(4):567-80. doi: 10.1016/j.molcel.2011.12.034.

Hernan, I. et al. Cellular Expression and siRNA-Mediated Interference of Rhodopsin cis-Acting Splicing Mutants Associated with Autosomal Dominant Retinitis Pigmentosa, Invest Ophthalmol. Vis. Sci. (2011) 52:3723-3729.

Heyn, P. et al. Introns and gene expression: Cellular constraints, transcriptional regulation, and evolutionary consequences. Bioessays vol. 37, pp. 148-154 (2014).

Hiller et al. Pre-mRNA secondary structures influence exon recognition. PLoS genetics 3.11 (2007): e204.

Hirata et al.Prevention of Experimental Autoimmune Encephalomyelitis by Transfer of Embryonic Stem Cell-Derived Dendritic Cells Expressing Myelin Oligodendrocyte Glycoprotein Peptide along with TRAIL or Programmed Death-1 Ligand.J. Immunology vol. 174 pp. 1888-1897 (2005).

Hishida, A. et al. Polymorphisms in PPAR Genes (PPARD, PPARG, and PPARGC1A) and the Risk of Chronic Kidney Disease in Japanese: Cross-Sectional Data from the J-MICC Study. PPAR 2013; 980471 pp. 1-8.

*Homo sapiens* pre-mRNA processing factor 3 (PRPF3), mRNA, NCBI Reference Sequence: NM_004698.2 Accessed Apr. 6, 2017.

Hua et al. Antisense masking of an hnRNP A1/A2 intronic splicing silencer corrects SMN2 splicing in transgenic mice. Am. J. Hum. Genet. 82:834-848 (Mar. 27, 2008).

Hua, et al. Antisense correction of SMN2 splicing in the CNS rescues necrosis in a type III SMA mouse model. Genes Dev. Aug. 1, 2010;24(15):1634-44. doi: 10.1101/gad.1941310. Epub Jul. 12, 2010.

Hua, Y., et al. Enhancement of SMN2 exon 7 inclusion by antisense oligonucleotides targeting the exon. PLoS Biol. 2007;5(4):e73. Epub Mar. 16, 2007.doi: 06-PLBI-RA-1492R3 [pii] 10.1371/journal.pbio.0050073. PubMed PMID: 17355180.

Hunt, et al. Negligible impact of rare autoimmune-locus coding-region variants on missing heritability. Nature. Jun. 13, 2013;498(7453):232-5. doi: 10.1038/nature12170. Epub May 22, 2013.

Huynh, K.D., et al. BCoR, a novel corepressor involved in BCL-6 repression. Genes Dev. 2000;14(14):1810-23. PubMed PMID: 10898795; PubMed Central PMCID: PMC316791.

International Application No. PCT/GB2015/051756 International Preliminary Report on Patentability, dated Dec. 26, 2016.

International Application No. PCT/GB2015/051756 International Search Report and Written Opinion dated Nov. 30, 2015.

International Application No. PCT/GB2016/053136 International Search Report and Written Opinion dated Mar. 6, 2017.

International Application No. PCT/GB2016/053136 Partial International Search Report dated Jan. 19, 2017.

International Application No. PCT/US16/66576 International Search Report and Written Opinion dated May 4, 2017.

International Application No. PCT/US16/66691 International Search Report and Written Opinion dated May 10, 2017.

International Application No. PCT/US16/66708 International Search Report and Written Opinion dated May 8, 2017.

International Application No. PCT/US16/66721 International Search Report and Written Opinion dated May 1, 2017.

International Application No. PCT/US2015/053896 International Preliminary Report on Patentability dated Apr. 4, 2017.

International Application No. PCT/US2015/53896 International Search Report and Written Opinion dated Mar. 3, 2016.

International Application No. PCT/US2016/066414 International Search Report and Written Opinion dated Apr. 19, 2017.

International Application No. PCT/US2016/066417 International Search Report and Written Opinion dated Apr. 19, 2017.

International Application No. PCT/US2016/066564 International Search Report and Written Opinion dated May 4, 2017.

International Application No. PCT/US2016/066705 International Search Report and Written Opinion dated Apr. 24, 2017.

International Application No. PCT/US2018/048031 International Search Report and Written Opinion dated Jan. 22, 2019.

International search report and written opinion dated Jun. 5, 2017 for PCT Application No. PCT/US2016/066684.

Iwamoto, et al. Transcription-dependent nucleolar cap localization and possible nuclear function of DExH RNA helicase RHAU. Exp Cell Res. Apr. 1, 2008;314(6):1378-91. doi: 10.1016/j.yexcr.2008.01.006. Epub Jan. 16, 2008.

Jacob et al. Intron retention as a component of regulated gene expression programs. Hum Genet 136:1043-1057 (2017).

Jarver, P. et al., A Chemical View of Oligonucleotides for Exon Skipping and Related Drug Applications, Nucleic Acid Therapeutics vol. 24, No. (1), pp. 37-47, (2014).

Jearawiriyapaisarn, et al. Sustained Dystrophin Expression Induced by Peptide-conjugated Morpholino Oligomers in the Muscles of mdx Mice. Mol Ther. Sep. 2008; 16(9): 1624-1629.

Jurkiewicz, D. et al. Spectrum of JAG1 gene mutations in Polish patients with Alagille syndrome J. Appl. Genetics vol. 55, pp. 329-336, (2014).

Kaminker, P.G., et al. A novel form of the telomere-associated protein TIN2 localizes to the nuclear matrix. Cell Cycle. 2009;8(6):931-9. PubMed PMID: 19229133; PubMed Central PMCID: PMC2751576.

Kang et al. Up-regulation of luciferase gene expression with antisense oligonucleotides: implications and applications in functional assay development. Biochemistry 37.18 (1998): 6235-6239.

Katsani, K.R. et al. Functional Genomics Evidence Unearths New Moonlighting Roles of Outer Ring Coat Nucleoporins Scientific Reports vol. 4, No. 4655 (Apr. 11, 2014).

Kawamata, N., et al. Genetic differences between Asian and Caucasian chronic lymphocytic leukemia. Int J Oncol. 2013;43(2):561-5. doi: 10.3892/ijo.2013.1966. PubMed PMID: 23708256; PubMed Central PMCID: PMC3775563.

Ke, et al. Quantitative evaluation of all hexamers as exonic splicing elements. Genome Res. Aug. 2011;21(8):1360-74. doi: 10.1101/gr.119628.110. Epub Jun. 9, 2011.

Keir, M.E. et al. PD-1 and Its Ligands in Tolerance and Immunity. Annu. Rev. Immunol. vol. 26, pp. 677-704 (2008).

(56) References Cited

OTHER PUBLICATIONS

Kervestin et al. NMD: a multifaceted response to premature translational termination. Nature reviews Molecular cell biology13.11 (2012): 700.
Kikin, et al. QGRS Mapper: a web-based server for predicting G-quadruplexes in nucleotide sequences. Nucleic Acids Res. Jul. 1, 2006;34(Web Server issue):W676-82.
Kim, E., et al. SRSF2 Mutations Contribute to Myelodysplasia by Mutant-Specific Effects on Exon Recognition. Cancer Cell. 2015;27(5):617-30. doi: 10.1016/j.ccell.2015.04.006. PubMed PMID: 25965569; PubMed Central PMCID: PMC4429920.
Kim et al. The role of synaptic GTPase-activating protein in neuronal development and synaptic plasticity. J. Neurosci. 23(4):1119-1124 (Feb. 15, 2003).
Kim, J. et al. The splicing factor U2AF65 stabilizes TRF1 protein by inhibiting its ubiquitin-dependent proteolysis. Biochem Biophys Res Commun. 2014;443(3):1124-30. doi: 10.1016/j.bbrc.2013.12.118. PubMed PMID: 24389012.
Kim P., et al. ChimerDB 2.0—a knowledgebase for fusion genes updated. Nucleic Acids Res. 2009;38(Database issue):D81-5. Epub Nov. 13, 2009.doi: gkp982 [pii] 10.1093/nar/gkp982. PubMed PMID: 19906715.
Kole, et al. RNA therapeutics: beyond RNA interference and antisense oligonucleotides. Nat Rev Drug Discov. Jan. 20, 2012;11(2):125-40. doi: 10.1038/nrd3625.
Kralovicova, et al. Allele-specific recognition of the 3' splice site of INS intron 1. Hum Genet. Oct. 2010;128(4):383-400. doi: 10.1007/s00439-010-0860-1. Epub Jul. 14, 2010.
Kralovicova, et al. Compensatory signals associated with the activation of human GC 5' splice sites. Nucleic Acids Res. Sep. 1, 2011;39(16):7077-91. doi: 10.1093/nar/gkr306. Epub May 23, 2011.
Kralovicova et al. Exon-centric regulation of ATM expression is population-dependent and amenable to antisense modification by pseudoexon targeting, Scientific Reports, 6:18741, doi:10.1038/srep18741, Jan. 6, 2016, 13 pages.
Kralovicova, et al. Global control of aberrant splice-site activation by auxiliary splicing sequences: evidence for a gradient in exon and intron definition. Nucleic Acids Res. Oct. 2007; 35(19): 6399-6413.
Kralovicova, et al. Identification of U2AF(35)-dependent exons by RNA-Seq reveals a link between 3' splice-site organization and activity of U2AF-related proteins. Nucleic Acids Res. Apr. 20, 2015;43(7):3747-63. doi: 10.1093/nar/gkv194. Epub Mar. 16, 2015.
Kralovicova, et al. Optimal antisense target reducing INS intron 1 retention is adjacent to a parallel G quadruplex. Nucleic Acids Res. Jul. 2014;42(12):8161-73. doi: 10.1093/nar/gku507. Epub Jun. 17, 2014.
Kralovicova, et al. Phenotypic consequences of branch point substitutions. Hum Mutat. Aug. 2006;27(8):803-13.
Kralovicova, et al. Position-dependent repression and promotion of DQB1 intron 3 splicing by GGGG motifs. J Immunol. Feb. 15, 2006;176(4):2381-8.
Kralovicova, et al. Variants in the human insulin gene that affect pre-mRNA splicing: is-23Hphl a functional single nucleotide polymorphism at IDDM2? Diabetes. Jan. 2006;55(1):260-4.
Kralovicova, et al. Antisense Oligonucleotides Modulating Activation of a Nonsense-Mediated RNA Decay Switch Exon in the ATM Gene.Nucleic Acid Ther. Dec. 1, 2016; 26(6): 392-400.
Kralovicova, J. et al. Branch sites haplotypes that control alternative splicing. Hum Mol Genet. 2004;13:3189-202.
Kralovicova, J. et al. The role of short RNA loops in recognition of a single-hairpin exon derived from a mammalian-wide interspersed repeat. RNA Biol. 2015;12(1):54-69. doi: 10.1080/15476286.2015.1017207. PubMed PMID: 25826413.
LaPlanche et al. Phosphorothioate-modified oligodeoxyribonucleotides. III. NMR and UV spectroscoptc studies of thRp-Rp,Sp-Sp, anRp-Sduplexes, [d(GGsAATTCC)]2, derived from diastereomeriO-ethyl phosphorothioates Nucleic Acids Res. vol. 14, No. 22, pp. 9081-9093 (Nov. 25, 1986).
Le Hir, et al. How introns influence and enhance eukaryotic gene expression. Trends Biochem Sci. Apr. 2003;28(4):215-20.

Lee, E.S. et al. The Consensus 5' Splice Site Motif Inhibits mRNA Nuclear Export.PLoS One vol. 10, No. 3, p. e0122743 (Mar. 31, 2015).
Lee, J., et al. Metastasis of neuroendocrine tumors are characterized by increased cell proliferation and reduced expression of the ATM gene. PLoS ONE. 2012;7:e34456.
LeHir, H. et al. 5'-End RET Splicing: Absence of Variants in Normal Tissues and Intron Retention in Pheochromocytomas, Oncology 63:84-91 (2002).
Lei et al. Exonization of Alu Ya5 in the human ACE gene requires mutations in both 3' and 5' splice sites and is facilitated by a conserved splicing enhancer. Nucleic acids research 33.12 (2005): 3897-3906.
Lei, et al. Identification of splicing silencers and enhancers in sense Alus: a role for pseudoacceptors in splice site repression. Mol Cell Biol. Aug. 2005;25(16):6912-20.
Lemaire, M., et al. CDC25B phosphorylation by p38 and MK-2. Cell Cycle. 2006;5(15):1649-53. PubMed PMID: 16861915.
Lev-Maor et al. Intronic Alus influence alternative splicing. PLoS genetics 4.9 (2008): e1000204.
Lev-Maor et al. The birth of an alternatively spliced exon: 3'splice-site selection in Alu exons. Science 300.5623 (2003): 1288-1291.
Levy et al.TranspoGene and microTranspoGene: transposed elements influence on the transcriptome of seven vertebrates and invertebrates. Nucleic acids research 36.suppl_1 (2007): D47-D52.
Li et al. PD-L1-Driven Tolerance Protects Neurogenin3-Induced Islet Neogenesis to Reverse Established Type 1 Diabetes in NOD Mice.Diabetes vol. 64, pp. 529-540 (Feb. 2015; epub Oct. 20, 2014).
Liang et al. Short intronic repeat sequences facilitate circular RNA production. Genes & development (2014): gad-251926.
Liang, Xue-Hai et al., T ranslation efficiency of mRNAs is increased by antisense oligonucleotides targeting upstream open reading frames,Nature Biotechnology, 34(8):875-882 (Aug. 2016).
Lianoglou, S., et al. Ubiquitously transcribed genes use alternative polyadenylation to achieve tissue-specific expression. Genes Dev. 2013;27(21):2380-96. Epub Oct. 23, 2013.doi: gad.229328.113 [pii] 10.1101/gad.229328.113. PubMed PMID: 24145798.
Lim et al. A computational analysis of sequence features involved in recognition of short introns. Proceedings of the National Academy of Sciences98.20 (2001): 11193-11198.
Litchfield, D.W., et al. Pin1: Intimate involvement with the regulatory protein kinase networks in the global phosphorylation landscape. Biochem Biophys Acta. 2015. doi: 10.1016/j.bbagen.2015.02.018. PubMed PMID: 25766872.
Llorian et al. Position-dependent alternative splicing activity revealed by global profiling of alternative splicing events regulated by PTB. Nature structural & molecular biology 17.9 (2010): 1114.
Lo, YL et al. ATM Polymorphisms and risk of lung cancer among never smokers, Lung Cancer 69(2):148-154 (2010).
Lorenz, et al. 2D meets 4G: G-Quadruplexes in RNA Secondary Structure Prediction. IEEE/ACM Trans Comput Biol Bioinform. Jul.-Aug. 2013;10(4):832-44. doi: 10.1109/TCBB.2013.7.
Lu, F. Conditional JAG1 MutationShows the Developing Heart Is More Sensitive Than Developing Liver to JAG1 Dosage.Am. J. Hum. Genet. vol. 72, pp. 1065-1070 (2003).
Ludecke et al.Recessively inherited L-DOPA-responsive parkinsonism in infancy caused by a point mutation (L205P) in the tyrosine hydroxylase gene Hum. Mol. Genet. vol. 5, pp. 1023-1028, (1996).
Luo et al. Palmitic Acid Suppresses Apolipoprotein M Gene Expression via the Pathway of PPARb/d in HepG2 Cells. Biochemical and Biophysical Research Communications, 445(1):203-207 (Feb. 2014).
Magi-Galuzzi, C. et al. TMPRSS2-ERG gene fusion prevalence and class are significantly difference in prostate cancer of Caucasian, African-American and Japanese patients. The Prostate. 2011;71:489-97.
Makishima, et al. Mutations in the spliceosome machinery, a novel and ubiquitous pathway in leukemogenesis. Blood. Apr. 5, 2012;119(14):3203-10. doi: 10.1182/blood-2011-12-399774. Epub Feb. 9, 2012.
Maniatis et al. An extensive network of coupling among gene expression machines. Nature 416.6880 (2002): 499.

(56) References Cited

OTHER PUBLICATIONS

Mansouri, S. et al. Epstein-Barr Virus EBNA1 Protein Regulates Viral Latency through Effects on let-7 MicroRNA and Dicer.Journal of Virology, vol. 88, No. 19, pp. 11166-11177, (Oct. 2014).

Marcel, et al. G-quadruplex structures in TP53 intron 3: role in alternative splicing and in production of p53 mRNA isoforms. Carcinogenesis. Mar. 2011;32(3):271-8. doi: 10.1093/carcin/bgq253. Epub Nov. 26, 2010.

Marquez, Y. et al. Unmasking alternative splicing inside protein-coding exons defines exitrons and their role inproteome plasticity. Genome vol. 25, pp. 995-1007 (2015).

Matsuoka, S., et al. Ataxia telangiectasia-mutated phosphorylates Chk2 in vivo and in vitro. Proc Natl Acad Sci USA. 2000;97:10389-94.

Matsuoka, S., et al. ATM and ATR substrate analysis reveals extensive protein networks responsive to DNA damage. Science. 2007;316(5828):1160-6. Epub May 26, 2007.doi: 316/5828/1160 [pii] 10.1126/science.1140321. PubMed PMID: 17525332.

Mayeda, et al. Surveying cis-acting sequences of pre-mRNA by adding antisense 2'-O-methyl oligoribonucleotides to a splicing reaction. J Biochem. Sep. 1990;108(3):399-405.

Melhuish, et al. The Tgif2 gene contains a retained intron within the coding sequence, BMC Molecular Biology 7(2);1-10 (2006).

Melko, et al. Functional characterization of the AFF (AF4/FMR2) family of RNA-binding proteins: insights into the molecular pathology of FRAXE intellectual disability. Hum Mol Genet. May 15, 2011;20(10):1873-85. doi: 10.1093/hmg/ddr069. Epub Feb. 17, 2011.

Mendell, J.T., ap Rhys CM, Dietz HC. Separable roles for rent1/hUpf1 in altered splicing and decay of nonsense transcripts. Science. 2002;298(5592):419-22. Epub Sep. 14, 2002.doi: 10.1126/science.1074428 1074428 [pii]. PubMed PMID: 12228722.

Merendino, L., et al. Inhibition of msl-2 splicing by Sex-lethal reveals interaction between U2AF35 and the 3' splice site AG. Nature. 1999;402(6763):838-41. PubMed PMID: 10617208.

Michael, et al. Mfold web server for nucleic acid folding and hybridization prediction. Nucleic Acids Research. 31 (2003): 3406-3415.

Miller at al. 1993-2015 GeneReviews Eds. Pagon RA et al. Seattle (WA); University of WA, Seattle Bookshelf ID NBK1318.

Millevoi, et al. G-quadruplexes in RNA biology. Wiley Interdiscip Rev RNA. Jul.-Aug. 2012;3(4):495-507. doi: 10.1002/wrna.1113. Epub Apr. 4, 2012.

Mirey, G., et al. CDC25B phosphorylated by pEg3 localizes to the centrosome and the spindle poles at mitosis. Cell Cycle. 2005;4(6):806-11. PubMed PMID: 15908796.

Mitelman, F., et al. The impact of translocations and gene fusions on cancer causation. Nat Rev Cancer. 2007;7(4):233-45. Epub Mar. 16, 2007.

Mochizuki, T. et al. PKD2, a gene for polycystic kidney disease that encodes an integral membrane protein.Science vol. 272, pp. 1339-1342 (1996).

Montecucco, A., et al. Pre-mRNA processing factors meet the DNA damage response. Front Genet. 2013;4:102. doi: 10.3389/fgene.2013.00102. PubMed PMID: 23761808; PubMed Central PMCID: PMC3674313.

Morris, et al. An RNA G-quadruplex is essential for cap-independent translation initiation in human VEGF IRES. J Am Chem Soc. Dec. 22, 2010;132(50):17831-9. doi: 10.1021/ja106287x. Epub Nov. 24, 2010.

Morrison, A.J., et al. Mec1/Tel1 phosphorylation of the INO80 chromatin remodeling complex influences DNA damage checkpoint responses. Cell. 2007;130(3):499-511. doi: 10.1016/j.cell.2007.06.010. PubMed PMID: 17693258.

Moskowitz, et al., Mutation in Scheie syndrome (MPS IS): a G-->A transition creates new splice site in intron 5 of one IDUA allele, Hum. Mutat. 2(2):141-144 (1993).

Mulley et al. A new molecular mechanism for severe myoclonic epilepsy of infancy: Exonic deletions in SCN1A.Neurol. vol. 67, pp. 1094-1095 (2006).

Mulley et al. SCN1A mutations and epilepsy.Hum. Muta. vol. 25, pp. 535-542 (2005).

Murray, S.F. et al. Allele-Specific Inhibition of Rhodopsin with an Antisense Oligonucleotide Slows Photoreceptor Cell Degeneration, Invest Ophthalmol. Vis. Sci. 56:6362-6375 (Oct. 2015).

Neidle, S. and Balasubramanian, S. (2006) Quadruplex Nucleic Acids. RSC Biomolecular Sciences, Cambridge, UK.

Nemeroff et al. Identification of cis-acting intron and exon regions in influenza virus NS1 mRNA that inhibit splicing and cause the formation of aberrantly sedimenting presplicing complexes. Molecular and cellular biology 12.3 (1992): 962-970.

Nguyen, L.A., et al. Physical and functional link of the leukemia-associated factors AML1 and PML. Blood. 2005;105(1):292-300. doi: 10.1182/blood-2004-03-1185. PubMed PMID: 15331439.

Nishi, M. et al. Insulin gene mutations and diabetes. Journal of Diabetes Investigation vol. 2 Issue 2 (Apr. 2011).

Nishida, A. et al. Tissue- and Case-specific retention of intron 40 in mature dystrophin mRNA, Journal of Human Genetic 60;327-333 (2015).

Nisole, S., et al. Differential Roles of PML Isoforms. Front Oncol. 2013;3:125. doi: 10.3389/fonc.2013.00125. PubMed PMID: 23734343; PubMed Central PMCID: PMC3660695.

Nomakuchi et al. Antisense-oligonucleotide-directed inhibition of nonsense-mediated mRNA decay. Nat. Biotechnol. 34(2):164-166 (Feb. 2016).

Nozu et al. Alport syndrome caused by a COL4A5 deletion and exonization of an adjacent AluY. Molecular genetics & genomic medicine 2.5 (2014): 451-453.

Nussinov. Conserved quartets near 5' intron junctions in primate nuclear pre-mRNA. J Theor Biol. Jul. 8, 1988;133(1):73-84.

Oda, T. et al. Identification and cloning of the human homolog (JAG) of the rat Jagged1 gene from the Alagille syndrome critical region at 20p12.Genomics vol. 43, No. 3, pp. 376-379 (1997).

Okazaki, T. et al. PD-1 and PD-1 ligands: from discovery to clinical application. International Immunology(The Japanese Society for Immunology), vol. 19, No. 7, pp. 813-824, (2007).

Oustric, V. et al. Antisense oligonucleotide-based therapy in human erythropoietic protoporphyria. Am J Hum Genet. 2014;94(4):611-7. doi: 10.1016/j.ajhg.2014.02.010. PubMed PMID: 24680888; PubMed Central PMCID: PMC3980518.

Pacheco, et al. Diversity of vertebrate splicing factor U2AF35: identification of alternatively spliced U2AF1 mRNAS. J Biol Chem. Jun. 25, 2004;279(26):27039-49. Epub Apr. 19, 2004.

Pacheco, et al. RNA interference knockdown of hU2AF35 impairs cell cycle progression and modulates alternative splicing of Cdc25 transcripts. Mol Biol Cell. Oct. 2006;17(10):4187-99. Epub Jul. 19, 2006.

Page-McCaw, P.S., et al. PUF60: a novel U2AF65-related splicing activity. RNA. 1999;5(12):1548-60. PubMed PMID: 10606266.

Pandit et al. Genome-wide analysis reveals SR protein cooperation and competition in regulated splicing. Molecular cell 50.2 (2013): 223-235.

Papaemmanuil, et al. Clinical and biological implications of driver mutations in myelodysplastic syndromes. Blood. Nov. 21, 2013;122(22):3616-27; quiz 3699. doi: 10.1182/blood-2013-08-518886. Epub Sep. 12, 2013.

Passamonti, C. et al. A novel inherited SCN1A mutation associated with different neuropsychological phenotypes: Is there a common core deficit? Epilepsy & Behavior 43:89-92 (2015).

Pastor, et al. Interaction of hnRNPA1/A2 and DAZAP1 with an Alu-derived intronic splicing enhancer regulates ATM aberrant splicing. PLoS One. 2011;6(8):e23349. doi: 10.1371/journal.pone.0023349. Epub Aug. 8, 2011.

Pastor, F., et al. Induction of tumour immunity by targeted inhibition of nonsense-mediated mRNA decay. Nature. 2010;465(7295):227-30. doi: 10.1038/nature08999. PubMed PMID: 20463739; PubMed Central PMCID: PMC3107067.

Paz, A., et al. SPIKE: a database of highly curated human signaling pathways. Nucleic Acids Res. 2011;39(Database issue):D793-9. doi: 10.1093/nar/gkq1167. PubMed PMID: 21097778; PubMed Central PMCID: PMC3014840.

Pear, Warren S. New roles for Notch in tuberous sclerosis, Journal of Clinical Investigation, 120(1):84-87 (Jan. 4, 2010).

(56) References Cited

OTHER PUBLICATIONS

Pecarelli et al. Regulation of natural mRNAs by the nonsense-mediated mRNA decay pathway. Eukaryotic cell(2014): EC-00090.
Pellagatti, A., et al. Deregulated gene expression pathways in myelodysplastic syndrome hematopoietic stem cells. Leukemia. 2010;24(4):756-64. doi: 10.1038/leu.2010.31. PubMed PMID: 20220779.
Peng, et al. Functional importance of different patterns of correlation between adjacent cassette exons in human and mouse. BMC Genomics. Apr. 26, 2008;9:191. doi: 10.1186/1471-2164-9-191.
Penton, A.L.Notch signaling in humandevelopment and disease. Seminars in Cell & Developmental Biology. vol. 23, pp. 450-457 (2012).
Perdiguero, E., et al. Regulation of Cdc25C activity during the meiotic G2/M transition. Cell Cycle. 2004;3(6):733-7. PubMed PMID: 15136768.
Piaceri, I., et al. Ataxia-telangiectasia mutated (ATM) genetic variant in Italian centenarians. Neurophysiology. 2013;34:573-5.
Pomentel et al. A dynamic intron retention program enriched in RNA processing genes regulates gene expression during terminal erythropoiesis. Nucleic acids research 44.2 (2015): 838-851.
Precursor mRNA-Processing Factor 3, S. Cerevisiae, Homolog of; PRPF3m, 3 pages.
Przychodzen, B., et al. Patterns of missplicing due to somatic U2AF1 mutations in myeloid neoplasms. Blood. 2013;122:999-1006. Epub Jun. 19, 2013.doi: blood-2013-01-480970 [pii] 10.1182/blood-2013-01-480970. PubMed PMID: 23775717.
Pugliese, et al. The insulin gene is transcribed in the human thymus and transcription levels correlated with allelic variation at the INS VNTR-IDDM2 susceptibility locus for type 1 diabetes. Nat Genet. Mar. 1997;15(3):293-7.
Ray, D. et al. A compendium of RNA-binding motifs for decoding gene regulation. Nature. vol. 499, No. 7457, pp. 172-177 (Jul. 11, 2013).
Reineke, E.L., et al. Degradation of the tumor suppressor PML by Pin1 contributes to the cancer phenotype of breast cancer MDA-MB-231 cells. Mol Cell Biol. 2008;28(3):997-1006. doi: 10.1128/MCB.01848-07. PubMed PMID: 18039859; PubMed Central PMCID: PMC2223389.
Rendu, J. et al. Hum Gene Ther. Exon skipping as a therapeutic strategy applied to an RYR1 mutation with pseudo-exon inclusion causing a severe core myopathy. Jul. 2013;24(7):702-13. doi: 10.1089/hum.2013.052.
Reynolds, DM et al.Aberrant Splicing in the PKD2 Gene as a Cause of Polycystic Kidney Disease.Am. Soc. Nephrol. vol. 10, pp. 2342-2351 (1999).
Ritprajak et al. Keratinocyte-Associated B7-H1 Directly Regulates Cutaneous Effector CD8+ T Cell Responses.J Immunology vol. 184, pp. 4918-4925 (2010).
RNA 2-14 The Nineteenth Annual Meeting of the RNA Society. Quebec City, Canada. (Jun. 3-8, 2014).
Roberts, Jennifer et al. Efficient and Persistent Splice Switching by Systemically Delivered LNA Oligonucleotides in Mice. Molecular Therapy, Nature Publishing, vol. 14, No. 4, pp. 471-475, Oct. 1, 2006.
Romero, P.R., et al. Alternative splicing in concert with protein intrinsic disorder enables increased functional diversity in multicellular organisms. Proc Natl Acad Sci USA. 2006;103(22):8390-5. Epub May 24, 2006.doi: 0507916103 [pii] 10.1073/pnas.0507916103. PubMed PMID: 16717195.
Rosenbloom et al. The UCSC Genome Browser database: 2015 Update. Nucleic Acids Research 43, Database Issue doi:101093/nar/gku1177.
Ruchlemer, R., et al. Geography, ethnicity and "roots" in chronic lymphocytic leukemia. Leuk Lymphoma. 2013;54(6):1142-50. doi: 10.3109/10428194.2012.740670. PubMed PMID: 23121522.
Rudd, M.F., et al. Variants in the ATM-BRCA2-CHEK2 axis predispose to chronic lymphocytic leukemia. Blood. 2006;108(2):638-44. Epub Apr. 1, 2006.doi: 2005-12-5022 [pii] 10.1182/blood-2005-12-5022. PubMed PMID: 16574953.

Ruskin, et al. A factor, U2AF, is required for U2 snRNP binding and splicing complex assembly. Cell. Jan. 29, 1988;52(2):207-19.
Sadleir, et al. Not all SCN1A epileptic encephalopathies are Dravet syndrome. Neurology. Sep. 5, 2017; 89(10): 1-8.
Sahashi et al. Pathological impact of SMN2 mis-splicing in adult SMA mice. EMBO Mol. Med. 5(10):1586-601 (Oct. 2013).
Sahashi et al. TSUNAMI: an antisense method to phenocopy splicing-associated diseases in animals. Genes Dev. 26(16):1874-1884 (Aug. 15, 2012).
Sakabe, et al. Sequence features responsible for intron retention in human. BMC Genomics. Feb. 26, 2007;8:59.
Samatanga, et al. The high kinetic stability of a G-quadruplex limits hnRNP F qRRM3 binding to G-tract RNA. Nucleic Acids Res. Feb. 1, 2013;41(4):2505-16. doi: 10.1093/nar/gks1289. Epub Dec. 28, 2012.
Schwarze, et al. Redefinition of exon 7 in the COL1A1 gene of type I collagen by an intron 8 splice-donor-site mutation in a form of osteogenesis imperfecta: influence of intron splice order on outcome of splice-site mutation. Am J Hum Genet. Aug. 1999;65(2):336-44.
Scott, S.P., et al. Missense mutations but not allelic variants alter the function of ATM by dominant interference in patients with breast cancer. Proc Natl Acad Sci USA. 2002;99:925-30.
SG 11201702682P Search Report and Written Opinion dated Apr. 9, 2018.
Shao, C., et al. Mechanisms for U2AF to define 3' splice sites and regulate alternative splicing in the human genome. Nat Struct Mol Biol. 2014;doi: 10.1038/nsmb.2906.
Shcherbakova, I., et al. Alternative spliceosome assembly pathways revealed by single-molecule fluorescence microscopy. Cell Rep. 2013;5(1):151-65. Epub Oct. 1, 2013.doi: S2211-1247(13)00467-1 [pii] 10.1016/j.celrep.2013.08.026. PubMed PMID: 24075986.
Shen, M., et al. Characterization and cell cycle regulation of the related human telomeric proteins Pin2 and TRF1 suggest a role in mitosis. Proc Natl Acad Sci USA. 1997;94(25):13618-23. PubMed PMID: 9391075; PubMed Central PMCID: PMC28355.
Shiloh, Y., et al The ATM protein kinase: regulating the cellular response to genotoxic stress, and more. Nat Rev Mol Cell Biol. 2013;14(4):197-210. doi: 10.1038/nrm3546. PubMed PMID: 23486281.
Shiria, C.L. et al. Mutant U2AF1 Expression Alters Hematopoiesis and Pre-mRNA Splicing In Vivo. Cancer Cell. 2015;27(5):631-43. doi: 10.1016/j.ccell.2015.04.008. PubMed PMID: 25965570; PubMed Central PMCID: PMC4430854.
Shirley, M.H., et al Incidence of haematological malignancies by ethnic group in England, Jul. 2001. Br J Haematol. 2013;163(4):465-77. doi: 10.1111/bjh.12562. PubMed PMID: 24033296.
Sierakowska, H et al. Repair of thalassemic human beta-globin mRNA in mammalian cells by antisense oligonucleotides. Proc Natl Acad Sci U S A. Nov. 12, 1996;93(23):12840-4.
Singh, et al. An antisense microwalk reveals critical role of an intronic position linked to a unique long-distance interaction in pre-mRNA splicing. RNA. Jun. 2010;16(6):1167-81. doi: 10.1261/rna.2154310. Epub Apr. 22, 2010.
Sirand-Pugnet, et al. An intronic (A/U)GGG repeat enhances the splicing of an alternative intron of the chicken beta-tropomyosin pre-mRNA. Nucleic Acids Res. Sep. 11, 1995;23(17):3501-7.
Skjevik et al. The N-Terminal Sequence of Tyrosine Hydroxylase Is a Conformationally Versatile Motif That Binds 14-3-3 Proteins and Membranes.J. Mol. Bio. vol. 426, pp. 150-168 (2014).
Smith, C.W., et al. Scanning and competition between AGs are involved in 3' splice site selection in mammalian introns. Mol Cell Biol. 1993;13(8):4939-52. PubMed PMID: 8336728.
Smith, et al. Alternative pre-mRNA splicing: the logic of combinatorial control. Trends Biochem Sci. Aug. 2000;25(8):381-8.
Smith, P.J., et al. An increased specificity score matrix for the prediction of SF2/ASF-specific exonic splicing enhancers. Hum Mol Genet. 2006;15(16):2490-508. PubMed PMID: 16825284.
Soo, R.A., et al. Ethnic differences in survival outcome in patients with advanced stage non-small cell lung cancer. J Thorac Oncol. 2011;6:1030-8.
Sorek et al. Minimal conditions for exonization of intronic sequences: 5' splice site formation in alu exons. Molecular cell 14.2 (2004): 221-231.

(56) References Cited

OTHER PUBLICATIONS

Soutar et al. Mechanisms of disease: genetic causes of familial hpercholesterolemia. Nat. Clin. Pract. Cardiovasc. Med. 4:214-255 (Apr. 1, 2007).
Spellman et al. Regulation of alternative splicing by PTB and associated factors. (2005): 457-460.
Stamm, S. Regulation of alternative splicing by reversible protein phosphorylation. J Biol Chem. 2008;283(3):1223-7. PubMed PMID: 18024427.
Stankovic, T., et al. Inactivation of ataxia telangiectasia mutated gene in B-cell chronic lymphocytic leukaemia. Lancet. 1999;353(9146):26-9. doi: 10.1016/S0140-6736(98)10117-4. PubMed PMID: 10023947.
Staropoli et al. Rescue of gene-expression changes in an induced mouse model of spinal muscular atrophy by an antisense oligonucleotide that promotes inclusion of SMN2 exon 7. Genomics 105:220-228 (2015).
Stead, et al. Global haplotype diversity in the human insulin gene region. Genome Res. Sep. 2003;13(9):2101-11.
Stec et al. Automated solid-phase synthesis, separation, and stereochemistry of phosphorothioate analogs of oligodeoxyribonucleotides J. Am. Chem. Soc., 1984, 106 (20), pp. 6077-6079 (1984).
Stein et al. Physicochemical properties of phosphorothioate oligodeoxynucleotides. Nucleic Acids Res. Apr. 25, 1988;16(8):3209-21.
Story, M.D. et al. ATM has a major role in the double-stand break repair pathway dysregulation in sporadic breast carcinomas and is an independent prognostic marker at both mRNA and protein levels, Breast Diseases: A Yearbook Quarterly, 26(4);297-299 (Mar. 17, 2015).
Strausfeld, U., et al. Activation of p34cdc2 protein kinase by microinjection of human cdc25C into mammalian cells. Requirement for prior phosphorylation of cdc25C by p34cdc2 on sites phosphorylated at mitosis. J Biol Chem. 1994;269(8):5989-6000. PubMed PMID: 8119945.
Suarez, F. et al. Incidence, presentation, and prognosis of malignancies in ataxia-telangiectasia: a report from the French national registry of primary immune deficiencies. J Clin Oncol. 2015;33(2):202-8. doi: 10.1200/JCO.2014.56.5101. PubMed PMID: 25488969.
Summerton, James. Morpholino Antisense Oligos: Applications in Biopharmaceutical ResearchMorpholinos constitute a radical redesign of DNA, providing decisive advantages over the moreconventional oligo types used for modulating gene expression. Innovations in Pharmaceutical Technology Issue No. 17 (2005).
Sun, H., et al. Multiple splicing defects in an intronic false exon. Mol Cell Biol. 2000;20(17):6414-25. PubMed PMID: 10938119.
Svasti, et al. RNA repair restores hemoglobin expression in IVS2-654 thalassemic mice. Proc Natl Acad Sci U S A. Jan. 27, 2009; 106(4): 1205-1210.
Swaans, RJM et al.Four novel mutations in the Tyrosine Hydroxylase gene in patients with infantile parkinsonism Annals of Human Genetic, vol. 64, No. 1, pp. 25-31, (Jan. 2000).
Tabrez, S. et al. A Synopsis of the Role of Tyrosine Hydroxylase in Parkinson's Disease.CNS & Neurological Disorders—Drug Targets vol. 11, No. 4 (2012).
Tavanez, J.P., et al. hnRNP A1 proofreads 3' splice site recognition by U2AF. Mol Cell. 2012;45(3):314-29. Epub Feb. 14, 2012. doi: S1097-2765(12)00032-9 [pii] 10.1016/j.molcel.2011.11.033. PubMed PMID: 22325350.
Taylor, A.M., et al. Ataxia telangiectasia: more variation at clinical and cellular levels. Clin Genet. 2015;87(3):199-208. doi: 10.1111/cge.12453. PubMed PMID: 25040471.
Taylor, A.M., et al. Leukemia and lymphoma in ataxia telangiectasia. Blood. 1996;87(2):423-38. PubMed PMID: 8555463.
Thisted, et al. Optimized RNA targets of two closely related triple KH domain proteins, heterogeneous nuclear ribonucleoprotein K and alphaCP-2KL, suggest Distinct modes of RNA recognition. J Biol Chem. May 18, 2001;276(20):17484-96. Epub Feb. 2, 2001.
Tilgner et al. Deep Sequencing of subcellular RNA factions shows splicing to be predominantly co-transcriptional in the human genome but inefficient for lncRNAs.Genome Research vol. 22, No. 9, pp. 1616-1625 (2012).
Torres, V.E. et al. Autosomal dominant polycystic kidney disease: the last 3 years.Kidney International vol. 76, pp. 149-168 (May 20, 2009).
Trabattoni, M. et al.Costimulatory Pathways in Multiple Disease Sclerosis: Distinctive Expression of PD-1 and PD-L1 in Patients with Different Patterns of Disease.J. Immunol. vol. 183, pp. 4984-4993 (2009).
Trapnell, C. et al. Differential gene and transcript expression analysis of RNA-seq experiments with Top Hat and Cufflinks. Nat Protoc. 2012;7(3):562-78. Epub Mar. 3, 2012.doi: nprot.2012.016 [pii] 10.1038/nprot.2012.016. PubMed PMID: 22383036.
Turnpenny, P.D. et al. Alagille syndrome: pathogenesis, diagnosis and management.European Journal of Human Genetics vol. 20, pp. 251-257 (2012.
Uhlmann, E. et al. Antisense oligonucleotides: a new therapeutic principle. Chemical Reviews vol. 90, No. 4, pp. 543-584 (Jun. 1990).
U.S. Appl. No. 14/741,071 Non-Final Office Action dated Dec. 1, 2016.
U.S. Appl. No. 14/874,420 Non-Final Office Action dated Mar. 21, 2017.
U.S. Appl. No. 14/874,420 Office Action dated Oct. 24, 2017.
U.S. Appl. No. 15/619,984 Office Action dated Dec. 17, 2018.
U.S. Appl. No. 15/949,902 Office Action dated Mar. 1, 2019.
U.S. Appl. No. 15/288,415 Office Action dated Jun. 26, 2018.
Vafiadis, et al. Insulin expression in human thymus is modulated by INS VNTR alleles at the IDDM2 locus. Nat Genet. Mar. 1997;15(3):289-92.
Verhaart, I.E.C. AON-Mediated Exon Skipping for Duchenne Muscular Dystrophy. Chapter 3. pp. 1-26 (Aug. 1, 2012).
Verret et al., Inhibitory Interneuron Deficit Links Altered Network Activity and Cognitive Dysfunction in Alzheimer Model, Cell, 149(3): 708-721 (2012).
Vieira, N. et al. Jagged 1Rescues the Duchenne Muscular Dystrophy Phenotype. Cell vol. 163, pp. 1204-1213 (Nov. 19, 2015).
Voelker, et al. A comprehensive computational characterization of conserved mammalian intronic sequences reveals conserved motifs associated with constitutive and alternative splicing. Genome Res. Jul. 2007;17(7):1023-33. Epub May 24, 2007.
Vorechovsky Correspondence Pediatric Research 2010.
Vorechovsky, I. Letter to the Editor: MER91B-assisted cryptic exon activation in Gitelman syndrome. Pediatric research 67.4 (2010): 444-445.
Vorechovsky Transposable elements in disease-associated cryptic exons. Human genetics 127.2 (2010): 135-154.
Wahl, et al. The spliceosome: design principles of a dynamic RNP machine. Cell. Feb. 20, 2009;136(4):701-18. doi: 10.1016/j.cell. 2009.02.009.
Wan et al.Synthesis, biophysical properties and biological activity of second generation antisense oligonucleotides containing chiral phosphorothioate linkages.Nucleic Acids Research, vol. 42, No. 22, pp. 13456-13468 (2014).
Wang, et al. A complex network of factors with overlapping affinities represses splicing through intronic elements. Nat Struct Mol Biol. Jan. 2013;20(1):36-45. doi: 10.1038/nsmb.2459. Epub Dec. 16, 2012.
Wang et al. Alternative isoform regulation in human tissue transcriptomes. Nature. 2008;456(November):470-476.
Wang et al. Human Adenovirus Type 36 Enhances Glucose Uptake in Diabetic and Nondiabetic Human Skeletal Muscle Cells Independent of Insulin Signaling.Diabetes vol. 57, pp. 1861-1869 (2008).
Wang, et al. Intronic splicing enhancers, cognate splicing factors and context-dependent regulation rules. Nat Struct Mol Biol. Oct. 2012;19(10):1044-52. doi: 10.1038/nsmb.2377. Epub Sep. 16, 2012.
Wang, et al. Regulation of insulin preRNA splicing by glucose. Proc Natl Acad Sci U S A. Apr. 29, 1997;94(9):4360-5.
Wang, Z. et al. Systematic identification and analysis of exonic splicing silencers. Cell. 2004;119(6):831-45. PubMed PMID: 15607979.

(56) References Cited

OTHER PUBLICATIONS

Warf, M.B., et al. Role of RNA structure in regulating pre-mRNA splicing. Trends Biochem Sci. 2010;35(3):169-78. Epub Dec. 5, 2009.doi: S0968-0004(09)00196-0 [pii].
Wieland, et al. RNA quadruplex-based modulation of gene expression. Chem Biol. Jul. 2007;14(7):757-63.
Wong et al. Orchestrated intron retention regulates normal granulocyte differentiation. Cell 154.3 (2013): 583-595.
Wu et al. AT-AC Pre-mRNA Splicing Mechanisms and Conservation of Minor Introns in Voltage-Gated Ion Channel Genes. Molecular and Cellular Biology 19(5): 3225-3236 (May 1999).
Wu, J.Y., et al. Specific interactions between proteins implicated in splice site selection and regulated alternative splicing. Cell. 1993;75(6):1061-70. Epub Dec. 17, 1993.doi: 0092-8674(93)90316-I [pii]. PubMed PMID: 8261509.
Wu, S. et al. Functional recognition of the 3' splice site AG by the splicing factor U2AF35.Nature. 1999;402(6763):832-5. PubMed PMID: 10617206.
Wu, Y. et al. MRE11-RAD50-NBS1 and ATM function as co-mediators of TRF1 in telomere length control. Nat Struct Mol Biol. 2007;14(9):832-40. doi: 10.1038/nsmb1286. PubMed PMID: 17694070.
Xia, Y. et al. Frequencies of SF3B1, NOTCH1, MYD88, BIRC3 and IGHV mutations and TP53 disruptions in Chinese with chronic lymphocytic leukemia: disparities with Europeans. Oncotarget. 2015;6(7):5426-34. PubMed PMID: 25605254.
Xing, et al. The multiassembly problem: reconstructing multiple transcript isoforms from EST fragment mixtures. Genome Res. Mar. 2004;14(3):426-41. Epub Feb. 12, 2004.
Yamamoto, Y., et al. BCOR as a novel fusion partner of retinoic acid receptor alpha in a t(X;17)(p11;q12) variant of acute promyelocytic leukemia. Blood. 2010;116(20):4274-83. doi: 10.1182/blood-2010-01-264432. PubMed PMID: 20807888.
Yan, et al. Systematic discovery of regulated and conserved alternative exons in the mammalian brain reveals NMD modulating chromatin regulators. Proc Natl Acad Sci U S A. Mar. 17, 2015; 112(11): 3445-3450.
Yang, S. et al. PML-dependent apoptosis after DNA damage is regulated by the checkpoint kinase hCds1/Chk2. Nat Cell Biol. 2002;4(11):865-70. doi: 10.1038/ncb869. PubMed PMID: 12402044.
Yang, S., et al. Promyelocytic leukemia activates Chk2 by mediating Chk2 autophosphorylation. J Biol Chem. 2006;281(36):26645-54. doi: 10.1074/jbc.M604391200. PubMed PMID: 16835227.
Yang, Y. et al.Oligomerization of the polycystin-2 C-terminal tail and effects on its Ca2+binding properties.J. Bio. Chem. vol. 290, No. 16, pp. 10544-10554 (2015).
Yeo, et al. Discovery and analysis of evolutionarily conserved intronic splicing regulatory elements. PLoS Genet. May 25, 2007;3(5):e85. Epub Apr. 13, 2007.
Yoshida, et al. Frequent pathway mutations of splicing machinery in myelodysplasia. Nature. Sep. 11, 2011;478(7367):64-9. doi: 10.1038/nature10496.
Yoshida, K., et al. Splicing factor mutations and cancer. Wiley Interdiscip Rev RNA. 2014;5(4):445-59. doi: 10.1002/wrna.1222. PubMed PMID: 24523246.
Yu, E.Y., et al. Regulation of telomere structure and functions by subunits of the INO80 chromatin remodeling complex. Mol Cell Biol. 2007;27(16):5639-49. doi: 10.1128/MCB.00418-07. PubMed PMID: 17562861; PubMed Central PMCID: PMC1952117.
Yuan X., et al. Nuclear protein profiling of Jurkat cells during heat stress-induced apoptosis by 2-DE and MS/MS. Electrophoresis. 2007;28(12):2018-26. doi: 10.1002/elps.200600821. PubMed PMID: 17523140.
Zamore, P.D., et al. Identification, purification, and biochemical characterization of U2 small nuclear ribonucleoprotein auxiliary factor. Proc Natl Acad Sci USA. 1989;86(23):9243-7. PubMed PMID: 2531895.
Zarnack K., et al. Direct competition between hnRNP C and U2AF65 protects the transcriptome from the exonization of Alu elements. Cell. 2013;152(3):453-66. Epub Feb. 5, 2013.doi: S0092-8674(12)01545-0 [pii] 10.1016/j.cell.2012.12.023. PubMed PMID: 23374342.
Zhang C., et al. RNA landscape of evolution for optimal exon and intron discrimination. Proc Natl Acad Sci USA. 2008;105(15):5797-802. Epub Apr. 9, 2008.doi: 0801692105 [pii] 10.1073/pnas.0801692105. PubMed PMID: 18391195.
Zhang, et al. Insulin as an autoantigen in NOD/human diabetes. Curr Opin Immunol. Feb. 2008;20(1):111-8. doi: 10.1016/j.coi.2007.11.005.
Zhang, et al. The kinetics and folding pathways of intramolecular G-quadruplex nucleic acids. J Am Chem Soc. Nov. 21, 2012;134(46):19297-308. doi: 10.1021/ja309851t. Epub Nov. 12, 2012.
Zhang, J. et al. PowerBLAST: A New Network BLAST Application for Interactive or Automated Sequence Analysis and Annotation Genome Res., vol. 7, pp. 649-656, (1997).
Zhang, X.H., et al. Computational definition of sequence motifs governing constitutive exon splicing. Genes Dev. 2004;18:1241-50. PubMed PMID: 15145827.
Zimrin et al. An Antisense Oligonucleotide to the Notch Ligand Jagged Enhances Firbroblast Growth Factor-induced Angiogenesis in Vitro. J. Biol. Chem. 271(51):32499-502 (Dec. 20, 1996).
Zon et al. Phosphorothioate oligonucleotides: chemistry, purification, analysis, scale-up and future directions. Anti Cancer Drug Design vol. 6, No. 6, pp. 539-568 (1991).
Zon G. and Stec,W.J. (1991) in Eckstein,F. (ed.), Oligonucleotides and Analogues: A Practical Approach. Oxford University Press, Oxford, UK, pp. 87-108.
Zorio, D.A., et al. Both subunits of U2AF recognize the 3' splice site in Caenorhabditis elegans. Nature. 1999;402(6763):835-8. PubMed PMID: 10617207.
Han Zhou et al: "Antisnse-Mediated Increase of SCN1A Expression Using TANGO Technology for the Treatment of Dravet Syndrome", Molecular Therapy, vol. 27, No. 4, Suppl. 1, Apr. 22, 2019 (Apr. 22, 2019), pp. 304-305.
Aceti, et al., "Syngap1 haploinsufficiency damages a postnatal critical period of pyramidal cell structural maturation linked to cortical circuit assembly" Biol Psychiatry (2015) 77(9): pp. 805-815.
Creson, et al., "Re-expression of SynGAP Protein in Adulthood Improves Translatable Measure of Brain Function and Behavior in a Model of Neurodevelopmental Disorders" BioRxiv (2018) pp. 1-27.
Han, et al., "Antisense oligonucleotides increase Scn1a expression and reduce seizures and SUDEP incidence in a mouse model of Dravet syndrome" Science Translational Medicine 12 (2020) pp. 1-14.
AU 2018322319 Examination Report No. 1 dated Oct. 16, 2020.
Braunschweig, Intron Retention, Supplemental Figure Legends, 2014.
Boutz, et al., Detained intron are a novel, widespread class of post-transcriptionally spliced introns, Genes & Development 29: 63-80, 2015.
Braunschweig et al., "Widespread intron retention in mammal functionally tunes transcriptomes", Chold Spring Harbor Laboratory Press, 2014 p. 1-14.
Collin, et al., "Antisense Oligonucleotide (AON)-based Therapy for Leber Congenital Amaurosis caused by a Frequent Mutation in CEP290", (2012) Molecular Therapy-Nucleic Acids, pp. 1-7.
Du, et al. "Correction of prototypic ATM splicing utations and aberrant ATM function with antisense morpholino oligonucleotides" (2007) PNAS, vol. 104, No. 14, pp. 6007-6012.
Du, et al., "Downregulation of neuronal sodium channel subunits Nav1. and Nav1.6 in the sinoatrial node from volume-overloaded heart failure rat", Pflugers Arch—Eur J Physiol (2007) 454:451-459.
Duikers, et al. "Antisense Oligonucleotide-Based Splicing Correction in Individuals with Leber Congenital Amaurosis due to Compound Heterozygosity for the c.2991+1655AG Mutation in CEP290" (2018) International Journal of Molecular Sciences, 19, 753, pp. 1-12.

(56) References Cited

OTHER PUBLICATIONS

Dulla, et al., "Splice-Modulating Oligonucleotide QR-110 Restores CEP290 mRNA and Function in Human c.2991+1655AG LCA10 Models" (2018) Molecular Therapy: Nucleic Acids, Volume, pp. 730-740.

Escayg et al., Sodium channel SCN1A and epilepsy: mutations and mechanisms, Epilepsia, Sep. 2010, vol. 51, No. 9, pp. 1-16.

Friedman, et al., "Correction of Aberrant Splicing of the Cystic Fibrosis Transmembrane conductance Regulator (CFTR) Gene by Antisense Oligonucleotides" (1999) The Journal of Biological Chemistry, vol. 274, No. 51, pp. 36193-36199.

Garanto, et al., "In vitro and in vivo rescue of aberrant splicing in CEP290-associted LCA by antisense oligonucleotide delivery" (2016) Human Molecular Genetics, vol. 25, No. 12, pp. 2552-2563.

Geary, et al., "Pharmacokinetics, biodistribution and cell uptake of antisense oligonucleotides", (2015) Advance Drug Delivery Reviews.

Gerard, et al., "AON-mediated Exon Skipping Restores ciliation in Fibroblasts Harboring the Common Leber Congenital Amaurosis CEP290 Mutation" (2012) Molecular Therapy-Nucleic Acids, pp. 1-9.

Goto, et al., "Targeted skipping of a Single Exon Harboring a Premature termination Codon Mutation: Implications and Potential for Gene Correction Therapy for Selective Dystrophic Epiderolysis Bullosa Patients" (2006) Journal of Investigative Dermatology, vol. 126, pp. s 2614-262.

Hammond, et al"Genetic therapies for RNA mis-splicing diseases" (2011) Cell Press 10 pages.

Han, et al., "TANGO—Targeted Augmentation of Nuclear Gene Output for the Treatment of Genetic Diseases" Poster.

Havens, et al., "Targeting RNA Splicing fo rDisease Therapy" (2013) Wiley Interdiscip Rev RNA , 4(3): 247-266.

Hug, et al., "Mechanism and regulation of the nonsense-mediated decay pathway", Nucleic Acids Research, 2016, vol. 44, No. 4 1483-1495.

International search report and written opinion dated Jun. 26, 2020 for PCT Application No. PCT/US20/20175.

International Search Report and Written Opinion for corresponding PCT application PCT/GB2016/053136 dated Jan. 19, 2017.

JP 2018-529250 Notice of Reasons for Rejection dated Nov. 19, 2020.

Kim, et al. "Reduced Sodium Channel nav1.1 Levels in BACE1-NULL Mice", JBC (2010) 1-21.

Kralovicova, et al., "Optimal antisense target reducing INS intron 1 retention is adjacent to a parallel G quadruplex" (2014) Nucleic Acids Research, v. 42, n. 12, p. 8161-8173.

Kralovicova, et al., "Exon-Centric Regulation of ATM expression is population-dependent and amenable to antisense modification by pseudoexon targeting", Scientific Reports (2016) p. 1-13.

Kralovicova, et al., "Global control of aberrant splice-site activation by auxiliary splicing sequences: evidence for a gradient in exon and intron definition", (2007) Nucleic Acids Research, v. 35, n. 19, p. 6399-6413.

Kwong et al. Identification of SCN1A and PCDH19 Mutations in Chinese Children with Dravet Syndrome. PloS one, vol. 7, Issue, 7, Jul. 2012: e41802.

Laceerra, et al., "Restoration of hemoglobin A synthesis in erythroid cells from peripheral blood of thalassemic patients" (2000) PNAS, vol. 97, No. 17, pp. 9591-9596.

Le Gal, et al., "A case of SUDEP in a patient with Dravet syndrome with SCNIA mutation" (2010) Epilepsia, 5199): 1915-1918.

LeFave,et al., "Splicing factor hnRNPH drives an oncogenic splicing switch in gliomas",(2011) The EMBO Journal, vol. 30, No. 19, pp. 4084-4097.

Levin, et al., "Treating Disease at the RNA Level with Oligonucleotides" (2019) The New England Journal of Medicine 380:57-70.

Liang, et al., "Translation efficiency of mRNAs is increased by antisnse oligonucleotides targeting upstream open reading frames" (2016) Nature Biotechnology, V. 34, N. 8, p. 875-882.

Lim, et al., "Antisense oligonucleotide modulation of non-productive alternative splicing upregulates gene expression" (2020) Nature Communication.

Vacher et al., "ATM has a major role in the double-strand break repair pathway dysregulation in sporadic breast carcinomas and is an independent prognostic marker at both mRNA and protein levels", (2015), Br J Cancer 112: 1059-1066.

Lo, et al., "ATM polymorphisms and risk of lung cancer among never smokers", (2010) Lund Cancer 69, p. 148-154.

Mantegazza et al., Identification of a Nav1.1 sodium channel (SCN1A) loss-of-function mutation associated with familial simple febrile seizures, PNAS, Dec. 13, 2005, vol. 102, No. 50, p. 18177-18182.

Martinez-Losa, et al."Nav1.1-Overexpressing Interneuron Transplants Restore Brain Tyhthms and Cognition in a Mouse Model of Alzheimer's Disease", Neuron. Apr. 4, 2018; 98(1): 75-89.

Menzi, et al., "Towards Improved Oligonucleotide Therapeutics Through Faster Target Binding Kinetics", (2017) ChemPubSoc Europe, 23, p. 14221-14230.

Ogiwara et al. Nav1.1 Localizes to Axons of Parvalbumin-Positive Inhibitory Interneurons: A Circuit Basis for Epileptic Seizures in Mice Carrying an Scn1a Gene Mutation. The Journal of Neuroscience 27(22):5903-5914 (May 30, 2007).

Parihar, et al., "The SCN1A gene variants and epileptic encephalophathies", Journal of Human Genetics (2013) 58, 573-580.

Raghavan, et al., "The spliceosomal U1 snRNP component Mud1 is autoregulated by promoting premature cleavage and polyadenylation of its own transcript", The Nineteenth Annual Meeting of the RNA Society.

Sazani, et al., "Therapeutic potential of antisense oligonucleotides as modulators of alternative splicing" (2003) The Journal of clinical Investigation, 112(4):481-486.

Scheffer, et al., "SCN1A-related pehnotypes: Epilepsy and beyond" Epilepsia (2019);60(s3):S17-S24.

U.S. Appl. No. 16/561,960 Pre-Interview First Office Action dated Dec. 19, 2019.

Van Wart, et al., "Imparied Firing an dCell-Specific compensation in Neurons Lacking Navv1.6 sodium Channels" The Journal of Neuroscience, (2006), 26(27):7172-7180.

Vickers, et al., "Fully modified 2' MOE oligonucleotides redirect polyadenylation", Isis Pharmaceuticals, Department of Molecular and Structural Biology, Nucleic Acids Research, 2001, vol. 29, No. 6 p. 1293-1299.

Vorechovsky, "Modulating Splicing-Mediated gene expression using antisense technology", Southhampton.sc.uk/business, 2016.

Weiss, et al., "Sodium channels SCN1A, SCN2A, SCN3A in familial autism", (2003) 8, p. 186-194.

Zammarchi, et al. "Antitumorigenic potential of STAT3 alternative splicing modulation", (2011) PNAS, vol. 108, No. 43, pp. 17779-17784.

| ID | Sequence (5'-3') |
|---|---|
| SCN1A-IVS21+6 | CAGAGAAAAUAGUGUUCA |
| SCN1A-IVS21+11 | AUAUUCAGAGAAAAUAGU |
| SCN1A-IVS21+16 | UAAAAAUAUUCAGAGAAA |
| SCN1A-IVS21+21 | AACAAUAAAAAUAUUCAG |
| SCN1A-IVS21+26 | UUCCAAACAAUAAAAAUA |
| SCN1A-IVS21+31 | UAUUAUUCCAAACAAUAA |
| SCN1A-IVS21+36 | UUUGUUAUUAUUCCAAAC |
| SCN1A-IVS21+41 | AUUAUUUUGUUAUUAUUC |
| SCN1A-IVS21+46 | AUGUCAUUAUUUUGUUAU |
| SCN1A-IVS21+51 | GAUGUAUGUCAUUAUUUU |
| SCN1A-IVS21+56 | UAAUAGAUGUAUGUCAUU |
| SCN1A-IVS21+61 | CUAAAUAAUAGAUGUAUG |
| SCN1A-IVS21+66 | AGGAACUAAAUAAUAGAU |
| SCN1A-IVS21+71 | UUCUUAGGAACUAAAUAA |
| SCN1A-IVS21+76 | ACUUUUCUUAGGAACUAA |
| SCN1A-IVS21+81 | UAUAUACUUUUCUUAGG |
| SCN1A-IVS21-16 | UGCAUGUAUGUUACUUUGA |
| SCN1A-IVS21-21 | GUUUUACUUUGGAGUAAA |
| SCN1A-IVS21-26 | ACUUUGGAGUAAAAAUAA |
| SCN1A-IVS21-31 | GGAGUAAAAAUAAUUUAG |
| SCN1A-IVS21-36 | AAAAAUAAUUUAGACCUG |
| SCN1A-IVS21-41 | UAAUUUAGACCUGAUGUU |
| SCN1A-IVS21-46 | UAGACCUGAUGUUUAAUA |
| SCN1A-IVS21-51 | CUGAUGUUUAAUAAAUAU |
| SCN1A-IVS21-56 | GUUUAAUAAAUAUUCUUA |
| SCN1A-IVS21-61 | AUAAAUAUUCUUACUGAU |
| SCN1A-IVS21-66 | UAUUCUUACUGAUAUAAU |
| SCN1A-IVS21-71 | UUACUGAUAUAAUUUUCA |
| SCN1A-IVS21-76 | GAUAUAAUUUUCAAAAGG |
| SCN1A-IVS21-81 | AAUUUUCAAAAGGGAAUA |

FIG. 8H

| ID | Sequence (5'-3') |
|---|---|
| SCN1A-IVS21-27 | CUUUGGAGUAAAAAUAAU |
| SCN1A-IVS21-28 | UUUGGAGUAAAAAUAAUU |
| SCN1A-IVS21-29 | UUGGAGUAAAAAUAAUUU |
| SCN1A-IVS21-30 | UGGAGUAAAAAUAAUUUA |
| SCN1A-IVS21-32 | GAGUAAAAAUAAUUUAGA |
| SCN1A-IVS21-33 | AGUAAAAAUAAUUUAGAC |
| SCN1A-IVS21-34 | GUAAAAAUAAUUUAGACC |
| SCN1A-IVS21-35 | UAAAAAUAAUUUAGACCU |
| SCN1A-IVS21-72 | UACUGAUAUAAUUUUCAA |
| SCN1A-IVS21-73 | ACUGAUAUAAUUUUCAAA |
| SCN1A-IVS21-74 | CUGAUAUAAUUUUCAAAA |
| SCN1A-IVS21-75 | UGAUAUAAUUUUCAAAAG |
| SCN1A-IVS21-77 | AUAUAAUUUUCAAAAGGG |
| SCN1A-IVS21-78 | UAUAAUUUUCAAAAGGGA |
| SCN1A-IVS21-79 | AUAAUUUUCAAAAGGGAA |
| SCN1A-IVS21-80 | UAAUUUUCAAAAGGGAAU |

FIG. 8I

ANTISENSE OLIGOMERS FOR TREATMENT OF AUTOSOMAL DOMINANT MENTAL RETARDATION-5 AND DRAVET SYNDROME

CROSS-REFERENCE

This application claims the benefit of U.S. Provisional Application No. 62/267,251, filed Dec. 14, 2015, which application is incorporated herein by reference.

STATEMENT AS TO FEDERALLY SPONSORED RESEARCH

This invention was made with government support under Grant No. GM042699 awarded by the National Institutes of Health. The government has certain rights in the invention.

REFERENCE TO A SEQUENCE LISTING

The instant application contains a Sequence Listing which has been filed electronically in ASCII format and is hereby incorporated by reference in its entirety. Said ASCII copy, created on Aug. 20, 2020, is named 47991-708_831_SL.txt and is 1,465,533 bytes in size.

BACKGROUND OF THE INVENTION

Mental retardation is the most prevalent handicap of children affecting 1 to 3% of the population. Autosomal Dominant Mental Retardation-5 (MRD5) is a prevalent nonsyndromic form of the disorder characterized by the lack of associated morphologic, radiologic, and metabolic features. A case study identified de novo genetic lesions in the SYNGAP1 gene that result in the production of truncated proteins in approximately 3% of patients with unexplained nonsyndromic mental retardation. SYNGAP1 is a GTPase-activating enzyme that is selectively expressed in the brain and required for normal development (Hamden, et al., 2009, NEJM 360: 599-605).

Dravet Syndrome (DS), also known as severe myoclonic epilepsy of infancy or SMEI, was first described by Dravet in 1978. It is a childhood epilepsy characterized by an onset of seizures during the first year of life that do not remit. Mutations in the SCN1A gene, which is part of the SCN1A-SCN2A-SCN3A gene cluster that encodes alpha-pore forming subunits of the neuronal voltage gated sodium channel, are associated with development of the disease (Miller, et al., 1993-2015, GeneReviews, Eds. Pagon R A, et al. Seattle (Wash.): University of Washington, Seattle, Bookshelf ID: NBK1318, and Mulley, et al., 2005, Hum. Mutat. 25: 535-542).

SUMMARY OF THE INVENTION

Disclosed herein, in some embodiments, are methods of treating a Autosomal Dominant Mental Retardation 5 (MRD5) or Dravet Syndrome (DS) in a subject in need thereof, by increasing the expression of a target protein or functional RNA by cells of the subject, wherein the cells have a retained-intron-containing pre-mRNA (RIC pre-mRNA), the RIC pre-mRNA comprising a retained intron, an exon flanking the 5' splice site, an exon flanking the 3' splice site, and wherein the RIC pre-mRNA encodes the target protein or functional RNA, the method comprising contacting the cells of the subject with an antisense oligomer (ASO) complementary to a targeted portion of the RIC pre-mRNA encoding the target protein or functional RNA, whereby the retained intron is constitutively spliced from the RIC pre-mRNA encoding the target protein or functional RNA, thereby increasing the level of mRNA encoding the target protein or functional RNA, and increasing the expression of the target protein or functional RNA in the cells of the subject.

Disclosed herein, in some embodiments, are methods of increasing expression of a target protein, wherein the target protein is SYNGAP1 or SCN1A, by cells having a retained-intron-containing pre-mRNA (RIC pre-mRNA), the RIC pre-mRNA comprising a retained intron, an exon flanking the 5' splice site of the retained intron, an exon flanking the 3' splice site of the retained intron, and wherein the RIC pre-mRNA encodes SYNGAP1 or SCN1A protein, the method comprising contacting the cells with an antisense oligomer (ASO) complementary to a targeted portion of the RIC pre-mRNA encoding SYNGAP1 or SCN1A protein, whereby the retained intron is constitutively spliced from the RIC pre-mRNA encoding SYNGAP1 or SCN1A protein, thereby increasing the level of mRNA encoding SYNGAP1 or SCN1A protein, and increasing the expression of SYNGAP1 or SCN1A protein in the cells.

In some embodiments of any of the aforementioned methods, the method is a method of treating MRD5 and the target protein is SYNGAP1, or the method is a method of treating DS and the target protein is SCN1A. In some embodiments, the target protein or the functional RNA is a compensating protein or a compensating functional RNA that functionally augments or replaces a target protein or functional RNA that is deficient in amount or activity in the subject. In some embodiments, the cells are in or from a subject having a condition caused by a deficient amount or activity of SYNGAP1 or SCN1A protein. In some embodiments, the deficient amount of the target protein is caused by haploinsufficiency of the target protein, wherein the subject has a first allele encoding a functional target protein, and a second allele from which the target protein is not produced, or a second allele encoding a nonfunctional target protein, and wherein the antisense oligomer binds to a targeted portion of a RIC pre-mRNA transcribed from the first allele. In some embodiments, the subject has a condition caused by a disorder resulting from a deficiency in the amount or function of the target protein, wherein the subject has (a) a first mutant allele from which (i) the target protein is produced at a reduced level compared to production from a wild-type allele, (ii) the target protein is produced in a form having reduced function compared to an equivalent wild-type protein, or (iii) the target protein is not produced, and (b) a second mutant allele from which (i) the target protein is produced at a reduced level compared to production from a wild-type allele, (ii) the target protein is produced in a form having reduced function compared to an equivalent wild-type protein, or (iii) the target protein is not produced, and wherein when the subject has a first mutant allele (a)(iii), the second mutant allele is (b)(i) or (b)(ii), and wherein when the subject has a second mutant allele (b)(iii), the first mutant allele is (a)(i) or (a)(ii), and wherein the RIC pre-mRNA is transcribed from either the first mutant allele that is (a)(i) or (a)(ii), and/or the second allele that is (b)(i) or (b)(ii). In some embodiments, the target protein is produced in a form having reduced function compared to the equivalent wild-type protein. In some embodiments, the target protein is produced in a form that is fully-functional compared to the equivalent wild-type protein.

In some embodiments of any of the aforementioned methods, the targeted portion of the RIC pre-mRNA is in the retained intron within the region +6 relative to the 5' splice site of the retained intron to −16 relative to the 3' splice site of the retained intron. In some embodiments, the targeted portion of the RIC pre-mRNA is in the retained intron within: (a) the region +6 to +499 relative to the 5' splice site of the retained intron; or (b) the region −16 to −496 relative to the 3' splice site of the retained intron. In some embodiments, the targeted portion of the RIC pre-mRNA is within: (a) the region +2e to −4e in the exon flanking the 5' splice site of the retained intron; or (b) the region +2e to −4e in the exon flanking the 3' splice site of the retained intron. In some embodiments, the targeted portion of the RIC pre-mRNA is within: (a) the region −4e to −1,054e relative to the 5' splice site of the retained intron; (b) the region +6 to +499 relative to the 5' splice site of the retained intron; (c) the region −16 to −496 relative to the 3' splice site of the retained intron; or (d) the region +2e to +1,912e relative to the 3' splice site of the retained intron.

In some embodiments of any of the aforementioned methods, the target protein is SCN1A. In some embodiments, the RIC pre-mRNA comprises a sequence with at least about 80%, 85%, 90%, 95%, 97%, or 100% sequence identity to any one of SEQ ID NOs: 4-7. In some embodiments, the RIC pre-mRNA is encoded by a genetic sequence with at least about 80%, 85%, 90%, 95%, 97%, or 100% sequence identity to SEQ ID NO: 1. In some embodiments, the targeted portion of the RIC pre-mRNA comprises a sequence with at least 80%, 85%, 90%, 95%, 97%, or 100% sequence identity to a region comprising at least 8 contiguous nucleic acids of SEQ ID NO: 2593. In some embodiments, the ASO comprises a sequence that is at least about 80%, 85%, 90%, 95%, 97%, or 100% complimentary to any one of SEQ ID NOs: 10-1037. In some embodiments, the targeted portion of the RIC pre-mRNA is within the region −264e to +496 relative to the 5' splice site of the retained intron 21 or within the region −496 to +37e relative to the 3' splice site of the retained intron 21. In some embodiments, the ASO comprises a sequence that is at least about 80%, 85%, 90%, 95%, 97%, or 100% complimentary to any one of SEQ ID NOs: 10-266 or 524-1037. In some embodiments, the targeted portion of the RIC pre-mRNA is within the region −264e to −4e relative to the 5' splice site of the retained intron 21. In some embodiments, the ASO comprises a sequence that is at least about 80%, 85%, 90%, 95%, 97%, or 100% complimentary to any one of SEQ ID NOs: 10-62, 524-576, or 781-833. In some embodiments, the targeted portion of the RIC pre-mRNA is in retained intron 21 within the region +6 to +496 relative to the 5' splice site of the retained intron 21. In some embodiments, the ASO comprises a sequence that is at least about 80%, 85%, 90%, 95%, 97%, or 100% complimentary to any one of SEQ ID NOs: 63-162, 577-675, or 834-932. In some embodiments, the targeted portion of the RIC pre-mRNA is in retained intron 21 within the region −16 to −496 relative to the 3' splice site of the retained intron 21. In some embodiments, the ASO comprises a sequence that is at least about 80%, 85%, 90%, 95%, 97%, or 100% complimentary to any one of SEQ ID NOs: 163-258, 676-772, or 933-1029. In some embodiments, the targeted portion of the RIC pre-mRNA is within the region +2e to +37e relative to the 3' splice site of the retained intron 21. In some embodiments, the ASO comprises a sequence that is at least about 80%, 85%, 90%, 95%, 97%, or 100% complimentary to any one of SEQ ID NOs: 259-266, 773-780, or 1030-1037.

In some embodiments of any of the aforementioned methods, the target protein is SCN1A. In some embodiments, the targeted portion of the RIC pre-mRNA is within the region −264e to +496 relative to the 5' splice site of the retained intron 23 or within the region −496 to +37e relative to the 3' splice site of the retained intron 23. In some embodiments, the ASO comprises a sequence that is at least about 80%, 85%, 90%, 95%, 97%, or 100% complimentary to any one of SEQ ID NOs: 267-523. In some embodiments, the targeted portion of the RIC pre-mRNA is within the region −264e to −4e relative to the 5' splice site of the retained intron 23. In some embodiments, the ASO comprises a sequence that is at least about 80%, 85%, 90%, 95%, 97%, or 100% complimentary to any one of SEQ ID NOs: 267-319. In some embodiments, the targeted portion of the RIC pre-mRNA is in retained intron 23 within the region +6 to +496 relative to the 5' splice site of the retained intron 23. In some embodiments, the ASO comprises a sequence that is at least about 80%, 85%, 90%, 95%, 97%, or 100% complimentary to any one of SEQ ID NOs: 320-418. In some embodiments, the targeted portion of the RIC pre-mRNA is in retained intron 23 within the region −16 to −496 relative to the 3' splice site of the retained intron 23. In some embodiments, the ASO comprises a sequence that is at least about 80%, 85%, 90%, 95%, 97%, or 100% complimentary to any one of SEQ ID NOs: 419-515. In some embodiments, the targeted portion of the RIC pre-mRNA is within the region +2e to +37e relative to the 3' splice site of the retained intron 23. In some embodiments, the ASO comprises a sequence that is at least about 80%, 85%, 90%, 95%, 97%, or 100% complimentary to any one of SEQ ID NOs: 516-523.

In some embodiments of any of the aforementioned methods, the target protein is SYNGAP1. In some embodiments, the RIC pre-mRNA comprises a sequence with at least about 80%, 85%, 90%, 95%, 97%, or 100% sequence identity to any one of SEQ ID NOs: 8 or 9. In some embodiments, the RIC pre-mRNA is encoded by a genetic sequence with at least about 80%, 85%, 90%, 95%, 97%, or 100% sequence identity to SEQ ID NO: 2 or 3. In some embodiments, the targeted portion of the RIC pre-mRNA comprises a sequence with at least 80%, 85%, 90%, 95%, 97%, or 100% sequence identity to a region comprising at least 8 contiguous nucleic acids of SEQ ID NO: 2592, 2594, or 2595. In some embodiments, the ASO comprises a sequence that is at least about 80%, 85%, 90%, 95%, 97%, or 100% complimentary to any one of SEQ ID NOs: 1038-2591. In some embodiments, the targeted portion of the RIC pre-mRNA is within the region −73e to +499 relative to the 5' splice site of the retained intron 18 or within the region −496 to +1,912e relative to the 3' splice site of the retained intron 19. In some embodiments, the ASO comprises a sequence that is at least about 80%, 85%, 90%, 95%, 97%, or 100% complimentary to any one of SEQ ID NOs: 1038-1509 or 1815-2286. In some embodiments, the targeted portion of the RIC pre-mRNA is within the region −73e to −4e relative to the 5' splice site of the retained intron 18. In some embodiments, the ASO comprises a sequence that is at least about 80%, 85%, 90%, 95%, 97%, or 100% complimentary to any one of SEQ ID NOs: 1038-1050 or 1815-1827. In some embodiments, the targeted portion of the RIC pre-mRNA is in retained intron 18 within the region +6 to +499 relative to the 5' splice site of the retained intron 18. In some embodiments, the ASO comprises a sequence that is at least about 80%, 85%, 90%, 95%, 97%, or 100% complimentary to any one of SEQ ID NOs: 1051-1136 or 1828-1913. In some embodiments, the targeted portion of the RIC pre-mRNA is in retained intron 19 within the region −16 to −496 relative to the 3' splice site of the retained intron 19. In some embodiments, the ASO comprises a sequence that is at least about 80%, 85%, 90%, 95%, 97%, or 100% complimentary to any one of SEQ ID NOs: 1137-1228 or 1914-2005. In some embodiments, the targeted portion of the RIC pre-mRNA is within the region +17e to +1,912e relative to the 3' splice site of the retained intron 19. In some embodiments, the ASO comprises a sequence that is at least about 80%, 85%, 90%, 95%, 97%, or 100% complimentary to any one of SEQ ID NOs: 1229-1509 or 2006-2286.

In some embodiments of any of the aforementioned methods, the target protein is SYNGAP1. In some embodiments, the targeted portion of the RIC pre-mRNA is within the region −1,054e to +251 relative to the 5' splice site of the retained intron 15 or within the region −256 to +157e relative to the 3' splice site of the retained intron 15. In some embodiments, the ASO comprises a sequence that is at least about 80%, 85%, 90%, 95%, 97%, or 100% complimentary to any one of SEQ ID NOs: 1510-1814 or 2287-2591. In some embodiments, the targeted portion of the RIC pre-mRNA is within the region −4e to −1,054e relative to the 5' splice site of the retained intron 15. In some embodiments, the ASO comprises a sequence that is at least about 80%, 85%, 90%, 95%, 97%, or 100% complimentary to any one of SEQ ID NOs: 1510-1686 or 2287-2463. In some embodiments, the targeted portion of the RIC pre-mRNA is in retained intron 15 within the region +6 to +251 relative to the 5' splice site of the retained intron 15. In some embodiments, the ASO comprises a sequence that is at least about 80%, 85%, 90%, 95%, 97%, or 100% complimentary to any one of SEQ ID NOs: 1687-1736 or 2464-2513. In some embodiments, the targeted portion of the RIC pre-mRNA is in retained intron 15 within the region −16 to −256 relative to the 3' splice site of the retained intron 15. In some embodiments, the ASO comprises a sequence that is at least about 80%, 85%, 90%, 95%, 97%, or 100% complimentary to any one of SEQ ID NOs: 1737-1785 or 2514-2562. In some embodiments, the targeted portion of the RIC pre-mRNA is within the region +2e to +157e relative to the 3' splice site of the retained intron 15. In some embodiments, the ASO comprises a sequence that is at least about 80%, 85%, 90%, 95%, 97%, or 100% complimentary to any one of SEQ ID NOs: 1786-1814 or 2563-2591.

In some embodiments of any of the aforementioned methods, the antisense oligomer does not increase the amount of the target protein or the functional RNA by modulating alternative splicing of pre-mRNA transcribed from a gene encoding the functional RNA or target protein. In some embodiments, the antisense oligomer does not increase the amount of the target protein or the functional RNA by modulating aberrant splicing resulting from mutation of the gene encoding the target protein or the functional RNA. In some embodiments, the RIC pre-mRNA was produced by partial splicing of a full-length pre-mRNA or partial splicing of a wild-type pre-mRNA. In some embodiments, the mRNA encoding the target protein or functional RNA is a full-length mature mRNA, or a wild-type mature mRNA. In some embodiments, the target protein produced is full-length protein, or wild-type protein. In some embodiments, the total amount of the mRNA encoding the target protein or functional RNA produced in the cell contacted with the antisense oligomer is increased about 1.1 to about 10-fold, about 1.5 to about 10-fold, about 2 to about 10-fold, about 3 to about 10-fold, about 4 to about 10-fold, about 1.1 to about 5-fold, about 1.1 to about 6-fold, about 1.1 to about 7-fold, about 2 to about 5-fold, about 2 to about 6-fold, about 2 to about 7-fold, about 2 to about 8-fold, about 2 to about 9-fold, about 3 to about 6-fold, about 3 to about 7-fold, about 3 to about 8-fold, about 3 to about 9-fold, about 4 to about 7-fold, about 4 to about 8-fold, about 4 to about 9-fold, at least about 1.1-fold, at least about 1.5-fold, at least about 2-fold, at least about 2.5-fold, at least about 3-fold, at least about 3.5-fold, at least about 4-fold, at least about 5-fold, or at least about 10-fold, compared to the total amount of the mRNA encoding the target protein or functional RNA produced in a control cell. In some embodiments, the total amount of target protein produced by the cell contacted with the antisense oligomer is increased about 1.1 to about 10-fold, about 1.5 to about 10-fold, about 2 to about 10-fold, about 3 to about 10-fold, about 4 to about 10-fold, about 1.1 to about 5-fold, about 1.1 to about 6-fold, about 1.1 to about 7-fold, about 1.1 to about 8-fold, about 1.1 to about 9-fold, about 2 to about 5-fold, about 2 to about 6-fold, about 2 to about 7-fold, about 2 to about 8-fold, about 2 to about 9-fold, about 3 to about 6-fold, about 3 to about 7-fold, about 3 to about 8-fold, about 3 to about 9-fold, about 4 to about 7-fold, about 4 to about 8-fold, about 4 to about 9-fold, at least about 1.1-fold, at least about 1.5-fold, at least about 2-fold, at least about 2.5-fold, at least about 3-fold, at least about 3.5-fold, at least about 4-fold, at least about 5-fold, or at least about 10-fold, compared to the total amount of target protein produced by a control cell.

In some embodiments of any of the aforementioned methods, the antisense oligomer comprises a backbone modification comprising a phosphorothioate linkage or a phosphorodiamidate linkage. In some embodiments, the antisense oligomer comprises a phosphorodiamidate morpholino, a locked nucleic acid, a peptide nucleic acid, a 2'-O-methyl, a 2'-Fluoro, or a 2'-O-methoxyethyl moiety. In some embodiments, the antisense oligomer comprises at least one modified sugar moiety. In some embodiments, each sugar moiety is a modified sugar moiety. In some embodiments, the antisense oligomer consists of from 8 to 50 nucleobases, 8 to 40 nucleobases, 8 to 35 nucleobases, 8 to 30 nucleobases, 8 to 25 nucleobases, 8 to 20 nucleobases, 8 to 15 nucleobases, 9 to 50 nucleobases, 9 to 40 nucleobases, 9 to 35 nucleobases, 9 to 30 nucleobases, 9 to 25 nucleobases, 9 to 20 nucleobases, 9 to 15 nucleobases, 10 to 50 nucleobases, 10 to 40 nucleobases, 10 to 35 nucleobases, 10 to 30 nucleobases, 10 to 25 nucleobases, 10 to 20 nucleobases, 10 to 15 nucleobases, 11 to 50 nucleobases, 11 to 40 nucleobases, 11 to 35 nucleobases, 11 to 30 nucleobases, 11 to 25 nucleobases, 11 to 20 nucleobases, 11 to 15 nucleobases, 12 to 50 nucleobases, 12 to 40 nucleobases, 12 to 35 nucleobases, 12 to 30 nucleobases, 12 to 25 nucleobases, 12 to 20 nucleobases, or 12 to 15 nucleobases. In some embodiments, the antisense oligomer is at least 80%, at least 85%, at least 90%, at least 95%, at least 98%, at least 99%, or 100%, complementary to the targeted portion of the RIC pre-mRNA encoding the protein.

In some embodiments of any of the aforementioned methods, the cell comprises a population of RIC pre-mRNAs transcribed from the gene encoding the target protein or functional RNA, wherein the population of RIC pre-mRNAs comprises two or more retained introns, and wherein the antisense oligomer binds to the most abundant retained intron in the population of RIC pre-mRNAs. In some embodiments, the binding of the antisense oligomer to the most abundant retained intron induces splicing out of the two or more retained introns from the population of RIC pre-mRNAs to produce mRNA encoding the target protein or functional RNA. In some embodiments, the cell comprises a population of RIC pre-mRNAs transcribed from the gene encoding the target protein or functional RNA, wherein the population of RIC pre-mRNAs comprises two or more retained introns, and wherein the antisense oligomer binds to the second most abundant retained intron in the population of RIC pre-mRNAs. In some embodiments, the binding of the antisense oligomer to the second most abundant retained intron induces splicing out of the two or more retained introns from the population of RIC pre-mRNAs to produce mRNA encoding the target protein or functional RNA. In some embodiments, the method further comprises assessing SYNGAP1 or SCN1A protein expression.

In some embodiments of any of the aforementioned methods, the MRD5 is treated and wherein the antisense oligomer binds to a targeted portion of a SYNGAP1 RIC pre-mRNA, wherein the targeted portion is within a sequence selected from SEQ ID NOs: 1038-2591, or wherein DS is treated and wherein the antisense oligomer binds to a targeted portion of a SCN1A RIC pre-mRNA, wherein the targeted portion is within a sequence selected from SEQ ID NOs: 10-1037. In some embodiments, the subject is a human. In some embodiments, the subject is a non-human animal. In some embodiments, the subject is a fetus, an embryo, or a child. In some embodiments, the cells are ex vivo. In some embodiments, the antisense oligomer is administered by intrathecal injection, intracerebroventricular injection, intraperitoneal injection, intramuscular injection, subcutaneous injection, or intravenous injection of the subject. In some embodiments, the 9 nucleotides at −3e to −1e of the exon flanking the 5' splice site and +1 to +6 of the retained intron, are identical to the corresponding wild-type sequence. In some embodiments, the 16 nucleotides at −15 to −1 of the retained intron and +1e of the exon flanking the 3' splice site are identical to the corresponding wild-type sequence. Disclosed herein, in some embodiments, are antisense oligomers as described in any of the aforementioned methods.

Disclosed herein, in some embodiments, are antisense oligomers comprising a sequence with at least about 80%, 85%, 90%, 95%, 97%, or 100% sequence identity to any one of SEQ ID NOs: 10-2591.

Also disclosed herein, in some embodiments, are pharmaceutical compositions comprising the antisense oligomer and a pharmaceutically acceptable excipient, diluent, or carrier.

Disclosed herein, in some embodiments, are methods of treating a subject in need thereof, by administering the pharmaceutical composition by intrathecal injection, intracerebroventricular injection, intraperitoneal injection, intramuscular injection, subcutaneous injection, or intravenous injection.

Disclosed herein, in some embodiments, are compositions comprising an antisense oligomer for use in a method of increasing expression of a target protein or a functional RNA by cells to treat MRD5 or DS in a subject in need thereof, associated with a deficient protein or deficient functional RNA, wherein the deficient protein or deficient functional RNA is deficient in amount or activity in the subject, wherein the antisense oligomer enhances constitutive splicing of a retained intron-containing pre-mRNA (RIC pre-mRNA) encoding the target protein or the functional RNA, wherein the target protein is: (a) the deficient protein; or (b) a compensating protein which functionally augments or replaces the deficient protein or in the subject; and wherein the functional RNA is: (c) the deficient RNA; or (d) a compensating functional RNA which functionally augments or replaces the deficient functional RNA in the subject; wherein the RIC pre-mRNA comprises a retained intron, an exon flanking the 5' splice site and an exon flanking the 3' splice site, and wherein the retained intron is spliced from the RIC pre-mRNA encoding the target protein or the functional RNA, thereby increasing production or activity of the target protein or the functional RNA in the subject.

Disclosed herein, in some embodiments, are compositions comprising an antisense oligomer for use in a method of treating a condition associated with SYNGAP1 or SCN1A protein in a subject in need thereof, the method comprising the step of increasing expression of SYNGAP1 or SCN1A protein by cells of the subject, wherein the cells have a retained-intron-containing pre-mRNA (RIC pre-mRNA) comprising a retained intron, an exon flanking the 5' splice site of the retained intron, an exon flanking the 3' splice site of the retained intron, and wherein the RIC pre-mRNA encodes the SYNGAP1 or SCN1A protein, the method comprising contacting the cells with the antisense oligomer, whereby the retained intron is constitutively spliced from the RIC pre-mRNA transcripts encoding SYNGAP1 or SCN1A protein, thereby increasing the level of mRNA encoding SYNGAP1 or SCN1A protein, and increasing the expression of SYNGAP1 or SCN1A protein, in the cells of the subject. In some embodiments, the condition is a disease or disorder. In some embodiments, the disease or disorder is AD mental retardation 5 or Dravet syndrome. In some embodiments, the target protein and RIC pre-mRNA are encoded by the SYNGAP1 or SCN1A gene. In some embodiments, the antisense oligomer targets a portion of the RIC pre-mRNA that is in the retained intron within the region +6 relative to the 5' splice site of the retained intron to −16 relative to the 3' splice site of the retained intron. In some embodiments, the antisense oligomer targets a portion of the RIC pre-mRNA that is in the retained intron within: (a) the region +6 to +499 relative to the 5' splice site of the retained intron; or (b) the region −16 to −496 relative to the 3' splice site of the retained intron. In some embodiments, the antisense oligomer targets a portion of the RIC pre-mRNA that is within the region about 100 nucleotides downstream of the 5' splice site of the at least one retained intron, to about 100 nucleotides upstream of the 3' splice site of the at least one retained intron. In some embodiments, the targeted portion of the RIC pre-mRNA is within: (a) the region +2e to −4e in the exon flanking the 5' splice site of the retained intron; or (b) the region +2e to −4e in the exon flanking the 3' splice site of the retained intron. In some embodiments, the targeted portion of the RIC pre-mRNA is within: (a) the region −4e to −1,054e relative to the 5' splice site of the retained intron; (b) the region +6 to +499 relative to the 5' splice site of the retained intron; (c) the region −16 to −496 relative to the 3' splice site of the retained intron; or (d) the region +2e to +1,912e relative to the 3' splice site of the retained intron.

In some embodiments of any of the aforementioned compositions, the target protein is SCN1A. In some embodiments, the RIC pre-mRNA comprises a sequence with at least about 80%, 85%, 90%, 95%, 97%, or 100% sequence identity to any one of SEQ ID NOs: 4-7. In some embodiments, the RIC pre-mRNA is encoded by a genetic sequence with at least about 80%, 85%, 90%, 95%, 97%, or 100% sequence identity to SEQ ID NO: 1. In some embodiments, the targeted portion of the RIC pre-mRNA comprises a sequence with at least 80%, 85%, 90%, 95%, 97%, or 100% sequence identity to a region comprising at least 8 contiguous nucleic acids of SEQ ID NO: 2593. In some embodiments, the ASO comprises a sequence that is at least about 80%, 85%, 90%, 95%, 97%, or 100% complimentary to any one of SEQ ID NOs: 10-1037. In some embodiments, the targeted portion of the RIC pre-mRNA is within the region −264e to +496 relative to the 5' splice site of the retained intron 21 or within the region −496 to +37e relative to the 3' splice site of the retained intron 21. In some embodiments, the ASO comprises a sequence that is at least about 80%, 85%, 90%, 95%, 97%, or 100% complimentary to any one of SEQ ID NOs: 10-266 or 524-1037. In some embodiments, the targeted portion of the RIC pre-mRNA is within the region −264e to −4e relative to the 5' splice site of the retained intron 21. In some embodiments, the ASO comprises a sequence that is at least about 80%, 85%, 90%, 95%, 97%, or 100% complimentary to any one of SEQ ID NOs: 10-62, 524-576, or 781-833. In some embodiments, the targeted portion of the RIC pre-mRNA is in retained intron 21 within the region +6 to +496 relative to the 5' splice site of the retained intron 21. In some embodiments, the ASO comprises a sequence that is at least about 80%, 85%, 90%, 95%, 97%, or 100% complimentary to any one of SEQ ID NOs: 63-162, 577-675, or 834-932. In some embodiments, the targeted portion of the RIC pre-mRNA is in retained intron 21 within the region −16 to −496 relative to the 3' splice site of the retained intron 21. In some embodiments, the ASO comprises a sequence that is at least about 80%, 85%, 90%, 95%, 97%, or 100% complimentary to any one of SEQ ID NOs: 163-258, 676-772, or 933-1029. In some embodiments, the targeted portion of the RIC pre-mRNA is within the region +2e to +37e relative to the 3' splice site of the retained intron 21. In some embodiments, the ASO comprises a sequence that is at least about 80%, 85%, 90%, 95%, 97%, or 100% complimentary to any one of SEQ ID NOs: 259-266, 773-780, or 1030-1037.

In some embodiments of any of the aforementioned compositions, the target protein is SCN1A. In some embodiments, the targeted portion of the RIC pre-mRNA is within the region −264e to +496 relative to the 5' splice site of the retained intron 23 or within the region −496 to +37e relative to the 3' splice site of the retained intron 23. In some embodiments, the ASO comprises a sequence that is at least about 80%, 85%, 90%, 95%, 97%, or 100% complimentary to any one of SEQ ID NOs: 267-523. In some embodiments, the targeted portion of the RIC pre-mRNA is within the region −264e to −4e relative to the 5' splice site of the retained intron 23. In some embodiments, the ASO comprises a sequence that is at least about 80%, 85%, 90%, 95%, 97%, or 100% complimentary to any one of SEQ ID NOs: 267-319. In some embodiments, the targeted portion of the RIC pre-mRNA is in retained intron 23 within the region +6 to +496 relative to the 5' splice site of the retained intron 23. In some embodiments, the ASO comprises a sequence that is at least about 80%, 85%, 90%, 95%, 97%, or 100% complimentary to any one of SEQ ID NOs: 320-418. In some embodiments, the targeted portion of the RIC pre-mRNA is in retained intron 23 within the region −16 to −496 relative to the 3' splice site of the retained intron 23. In some embodiments, the ASO comprises a sequence that is at least about 80%, 85%, 90%, 95%, 97%, or 100% complimentary to any one of SEQ ID NOs: 419-515. In some embodiments, the targeted portion of the RIC pre-mRNA is within the region +2e to +37e relative to the 3' splice site of the retained intron 23. In some embodiments, the ASO comprises a sequence that is at least about 80%, 85%, 90%, 95%, 97%, or 100% complimentary to any one of SEQ ID NOs: 516-523.

In some embodiments of any of the aforementioned compositions, the target protein is SYNGAP1. In some embodiments, the RIC pre-mRNA comprises a sequence with at least about 80%, 85%, 90%, 95%, 97%, or 100% sequence identity to any one of SEQ ID NOs: 8 or 9. In some embodiments, the RIC pre-mRNA is encoded by a genetic sequence with at least about 80%, 85%, 90%, 95%, 97%, or 100% sequence identity to SEQ ID NO: 2 or 3. In some embodiments, the targeted portion of the RIC pre-mRNA comprises a sequence with at least 80%, 85%, 90%, 95%, 97%, or 100% sequence identity to a region comprising at least 8 contiguous nucleic acids of SEQ ID NO: 2592, 2594, or 2595. In some embodiments, the ASO comprises a sequence that is at least about 80%, 85%, 90%, 95%, 97%, or 100% complimentary to any one of SEQ ID NOs: 1038-2591. In some embodiments, the targeted portion of the RIC pre-mRNA is within the region −73e to +499 relative to the 5' splice site of the retained intron 18 or within the region −496 to +1,912e relative to the 3' splice site of the retained intron 19. In some embodiments, the ASO comprises a sequence that is at least about 80%, 85%, 90%, 95%, 97%, or 100% complimentary to any one of SEQ ID NOs: 1038-1509 or 1815-2286. In some embodiments, the targeted portion of the RIC pre-mRNA is within the region −73e to −4e relative to the 5' splice site of the retained intron 18. In some embodiments, the ASO comprises a sequence that is at least about 80%, 85%, 90%, 95%, 97%, or 100% complimentary to any one of SEQ ID NOs: 1038-1050 or 1815-1827. In some embodiments, the targeted portion of the RIC pre-mRNA is in retained intron 18 within the region +6 to +499 relative to the 5' splice site of the retained intron 18. In some embodiments, the ASO comprises a sequence that is at least about 80%, 85%, 90%, 95%, 97%, or 100% complimentary to any one of SEQ ID NOs: 1051-1136 or 1828-1913. In some embodiments, the targeted portion of the RIC pre-mRNA is in retained intron 19 within the region −16 to −496 relative to the 3' splice site of the retained intron 19. In some embodiments, the ASO comprises a sequence that is at least about 80%, 85%, 90%, 95%, 97%, or 100% complimentary to any one of SEQ ID NOs: 1137-1228 or 1914-2005. In some embodiments, the targeted portion of the RIC pre-mRNA is within the region +17e to +1,912e relative to the 3' splice site of the retained intron 19. In some embodiments, the ASO comprises a sequence that is at least about 80%, 85%, 90%, 95%, 97%, or 100% complimentary to any one of SEQ ID NOs: 1229-1509 or 2006-2286.

In some embodiments of any of the aforementioned compositions, the target protein is SYNGAP1. In some embodiments, the targeted portion of the RIC pre-mRNA is within the region −1,054e to +251 relative to the 5' splice site of the retained intron 15 or within the region −256 to +157e relative to the 3' splice site of the retained intron 15. In some embodiments, the ASO comprises a sequence that is at least about 80%, 85%, 90%, 95%, 97%, or 100% complimentary to any one of SEQ ID NOs: 1510-1814 or 2287-2591. In some embodiments, the targeted portion of the RIC pre-mRNA is within the region −4e to −1,054e relative to the 5' splice site of the retained intron 15. In some embodiments, the ASO comprises a sequence that is at least about 80%, 85%, 90%, 95%, 97%, or 100% complimentary to any one of SEQ ID NOs: 1510-1686 or 2287-2463. In some embodiments, the targeted portion of the RIC pre-mRNA is in retained intron 15 within the region +6 to +251 relative to the 5' splice site of the retained intron 15. In some embodiments, the ASO comprises a sequence that is at least about 80%, 85%, 90%, 95%, 97%, or 100% complimentary to any one of SEQ ID NOs: 1687-1736 or 2464-2513. In some embodiments, the targeted portion of the RIC pre-mRNA is in retained intron 15 within the region −16 to −256 relative to the 3' splice site of the retained intron 15. In some embodiments, the ASO comprises a sequence that is at least about 80%, 85%, 90%, 95%, 97%, or 100% complimentary to any one of SEQ ID NOs: 1737-1785 or 2514-2562. In some embodiments, the targeted portion of the RIC premRNA is within the region +2e to +157e relative to the 3' splice site of the retained intron 15. In some embodiments, the ASO comprises a sequence that is at least about 80%, 85%, 90%, 95%, 97%, or 100% complimentary to any one of SEQ ID NOs: 1786-1814 or 2563-2591.

In some embodiments of any of the aforementioned compositions, the antisense oligomer does not increase the amount of target protein or functional RNA by modulating alternative splicing of the pre-mRNA transcribed from a gene encoding the target protein or functional RNA. In some embodiments, the antisense oligomer does not increase the amount of the functional RNA or functional protein by modulating aberrant splicing resulting from mutation of the gene encoding the target protein or functional RNA. In some embodiments, the RIC pre-mRNA was produced by partial splicing from a full-length pre-mRNA or a wild-type pre-mRNA. In some embodiments, the mRNA encoding the target protein or functional RNA is a full-length mature mRNA, or a wild-type mature mRNA. In some embodiments, the target protein produced is full-length protein, or wild-type protein. In some embodiments, the retained intron is a rate-limiting intron. In some embodiments, the retained intron is the most abundant retained intron in said RIC pre-mRNA. In some embodiments, the retained intron is the second most abundant retained intron in said RIC pre-mRNA.

In some embodiments of any of the aforementioned compositions, the antisense oligomer comprises a backbone modification comprising a phosphorothioate linkage or a phosphorodiamidate linkage. In some embodiments, the antisense oligomer is an antisense oligonucleotide. In some embodiments, the antisense oligomer comprises a phosphorodiamidate morpholino, a locked nucleic acid, a peptide nucleic acid, a 2'-O-methyl, a 2'-Fluoro, or a 2'-O-methoxyethyl moiety. In some embodiments, the antisense oligomer comprises at least one modified sugar moiety. In some embodiments, each sugar moiety is a modified sugar moiety. In some embodiments, the antisense oligomer consists of from 8 to 50 nucleobases, 8 to 40 nucleobases, 8 to 35 nucleobases, 8 to 30 nucleobases, 8 to 25 nucleobases, 8 to 20 nucleobases, 8 to 15 nucleobases, 9 to 50 nucleobases, 9 to 40 nucleobases, 9 to 35 nucleobases, 9 to 30 nucleobases, 9 to 25 nucleobases, 9 to 20 nucleobases, 9 to 15 nucleobases, 10 to 50 nucleobases, 10 to 40 nucleobases, 10 to 35 nucleobases, 10 to 30 nucleobases, 10 to 25 nucleobases, 10 to 20 nucleobases, 10 to 15 nucleobases, 11 to 50 nucleobases, 11 to 40 nucleobases, 11 to 35 nucleobases, 11 to 30 nucleobases, 11 to 25 nucleobases, 11 to 20 nucleobases, 11 to 15 nucleobases, 12 to 50 nucleobases, 12 to 40 nucleobases, 12 to 35 nucleobases, 12 to 30 nucleobases, 12 to 25 nucleobases, 12 to 20 nucleobases, or 12 to 15 nucleobases.

Disclosed herein, in some embodiments, are pharmaceutical compositions comprising the antisense oligomer of any of the compositions, and a pharmaceutically acceptable excipient, diluent, or carrier. Also disclosed herein, in some embodiments, are methods of treating a subject in need thereof, by administering the pharmaceutical composition by intrathecal injection, intracerebroventricular injection, intraperitoneal injection, intramuscular injection, subcutaneous injection, or intravenous injection.

Disclosed herein, in some embodiments, are pharmaceutical compositions comprising: an antisense oligomer that hybridizes to a target sequence of a SCN1A or SYNGAP1 mRNA transcript, wherein the SCN1A or SYNGAP1 mRNA transcript comprises a retained intron, wherein the antisense oligomer induces splicing out of the retained intron from the SCN1A or SYNGAP1 mRNA transcript; and a pharmaceutically acceptable excipient, diluent, or carrier. In some embodiments, the SCN1A or SYNGAP1 mRNA transcript is a SCN1A or SYNGAP1 RIC pre-mRNA transcript. In some embodiments, the targeted portion of the SCN1A or SYNGAP1 RIC pre-mRNA transcript is in the retained intron within the region +500 relative to the 5' splice site of the retained intron to −500 relative to the 3' spliced site of the retained intron. In some embodiments, the SCN1A or SYNGAP1 RIC pre-mRNA transcript is encoded by a genetic sequence with at least about 80%, 85%, 90%, 95%, 96%, 97%, 98%, 99% or 100% sequence identity to any one of SEQ ID NOs: 1-3. In some embodiments, the SCN1A or SYNGAP1 RIC pre-mRNA transcript comprises a sequence with at least about 80%, 85%, 90%, 95%, 96%, 97%, 98%, 99% or 100% sequence identity to any one of SEQ ID NOs: 4-9. In some embodiments, the antisense oligomer comprises a backbone modification comprising a phosphorothioate linkage or a phosphorodiamidate linkage. In some embodiments, the antisense oligomer is an antisense oligonucleotide. In some embodiments, the antisense oligomer comprises a phosphorodiamidate morpholino, a locked nucleic acid, a peptide nucleic acid, a 2'-O-methyl, a 2'-Fluoro, or a 2'-O-methoxyethyl moiety. In some embodiments, the antisense oligomer comprises at least one modified sugar moiety. In some embodiments, the antisense oligomer comprises from 8 to 50 nucleobases, 8 to 40 nucleobases, 8 to 35 nucleobases, 8 to 30 nucleobases, 8 to 25 nucleobases, 8 to 20 nucleobases, 8 to 15 nucleobases, 9 to 50 nucleobases, 9 to 40 nucleobases, 9 to 35 nucleobases, 9 to 30 nucleobases, 9 to 25 nucleobases, 9 to 20 nucleobases, 9 to 15 nucleobases, 10 to 50 nucleobases, 10 to 40 nucleobases, 10 to 35 nucleobases, 10 to 30 nucleobases, 10 to 25 nucleobases, 10 to 20 nucleobases, 10 to 15 nucleobases, 11 to 50 nucleobases, 11 to 40 nucleobases, 11 to 35 nucleobases, 11 to 30 nucleobases, 11 to 25 nucleobases, 11 to 20 nucleobases, 11 to 15 nucleobases, 12 to 50 nucleobases, 12 to 40 nucleobases, 12 to 35 nucleobases, 12 to 30 nucleobases, 12 to 25 nucleobases, 12 to 20 nucleobases, or 12 to 15 nucleobases. In some embodiments, the antisense oligomer is at least 80%, at least 85%, at least 90%, at least 95%, at least 98%, at least 99%, or is 100% complementary to a targeted portion of the SCN1A or SYNGAP1 RIC pre-mRNA transcript. In some embodiments, the targeted portion of the SCN1A or SYNGAP1 RIC pre-mRNA transcript is within a sequence selected from SEQ ID NOs: 2592-2595. In some embodiments, the antisense oligomer comprises a nucleotide sequence that is at least about 80%, 85%, 90%, 91%, 92%, 93%, 94%, 95%, 96%, 97%, 98%, or 99% sequence identity to any one of SEQ ID NOs: 10-2591. In some embodiments, the antisense oligomer comprises a nucleotide sequence selected from SEQ ID NOs: 10-2591. In some embodiments, the pharmaceutical composition is formulated for intrathecal injection, intracerebroventricular injection, intraperitoneal injection, intramuscular injection, subcutaneous injection, or intravenous injection.

Disclosed herein, in some embodiments, are methods of inducing processing of a deficient SCN1A or SYNGAP1 mRNA transcript to facilitate removal of a retained intron to produce a fully processed SCN1A or SYNGAP1 mRNA transcript that encodes a functional form of a SCN1A or SYNGAP1 protein, the method comprising: (a) contacting an antisense oligomer to a target cell of a subject; (b) hybridizing the antisense oligomer to the deficient SCN1A or SYNGAP1 mRNA transcript, wherein the deficient SCN1A or SYNGAP1 mRNA transcript is capable of encoding the functional form of a SCN1A or SYNGAP1 protein and comprises at least one retained intron; (c) removing the at least one retained intron from the deficient SCN1A or SYNGAP1 mRNA transcript to produce the fully processed SCN1A or SYNGAP1 mRNA transcript that encodes the functional form of SCN1A or SYNGAP1 protein; and (d) translating the functional form of SCN1A or SYNGAP1 protein from the fully processed SCN1A or SYNGAP1 mRNA transcript. In some embodiments, the retained intron is an entire retained intron. In some embodiments, the deficient SCN1A or SYNGAP1 mRNA transcript is a SCN1A or SYNGAP1 pre-mRNA transcript.

Disclosed herein, in some embodiments, are methods of treating a subject having a condition caused by a deficient amount or activity of SCN1A or SYNGAP1 protein comprising administering to the subject an antisense oligomer comprising a nucleotide sequence with at least about 80%, 85%, 90%, 91%, 92%, 93%, 94%, 95%, 96%, 97%, 98%, or 99% sequence identity to any one of SEQ ID NOs: 10-2591.

INCORPORATION BY REFERENCE

All publications, patents, and patent applications mentioned in this specification are herein incorporated by reference to the same extent as if each individual publication, patent, or patent application was specifically and individually indicated to be incorporated by reference.

BRIEF DESCRIPTION OF THE DRAWINGS

The novel features of the invention are set forth with particularity in the appended claims. A better understanding of the features and advantages of the present invention will be obtained by reference to the following detailed description that sets forth illustrative embodiments, in which the principles of the invention are utilized, and the accompanying drawings.

In FIG. 1, the 5' splice site consensus sequence is indicated with underlined letters (letters are nucleotides; upper case: exonic portion; and lower case: intronic portion) from −3e to −1e and +1 to +6 (numbers labeled "e" are exonic and unlabeled numbers are intronic). The 3' splice site consensus sequence is indicated with underlined letters (letters are nucleotides; upper case: exonic portion and lower case: intronic portion) from −15 to −1 and +1e (numbers labeled "e" are exonic and unlabeled numbers are intronic). Intronic target regions for ASO screening comprise nucleotides +6 relative to the 5' splice site of the retained intron (arrow at left) to −16 relative to the 3' splice site of the retained intron (arrow at right). In embodiments, intronic target regions for ASO screening comprise nucleotides +6 to +496 relative to the 5' splice site of the retained intron and −16 to −499 relative to the 3' splice site of the retained intron. Exonic target regions comprise nucleotides +2e to −4e in the exon flanking the 5' splice site of the retained intron and +2e to −4e in the exon flanking the 3' splice site of the retained intron. "n" or "N" denote any nucleotide, "y" denotes pyrimidine. The sequences shown represent consensus sequences for mammalian splice sites and individual introns and exons need not match the consensus sequences at every position. Figure discloses SEQ ID NOS 2613 and 2614, respectively, in order of appearance.

FIG. 2A shows a cell divided into nuclear and cytoplasmic compartments. In the nucleus, a pre-mRNA transcript of a target gene consisting of exons (rectangles) and introns (connecting lines) undergoes splicing to generate an mRNA, and this mRNA is exported to the cytoplasm and translated into target protein. For this target gene, the splicing of intron 1 is inefficient and a retained intron-containing (RIC) pre-mRNA accumulates primarily in the nucleus, and if exported to the cytoplasm, is degraded, leading to no target protein production. FIG. 2B shows an example of the same cell divided into nuclear and cytoplasmic compartments. Treatment with an antisense oligomer (ASO) promotes the splicing of intron 1 and results in an increase in mRNA, which is in turn translates into higher levels of target protein.

FIG. 8H depicts the sequences of the ASOs used in the experiments shown in FIG. 8D and FIG. 8E.

FIG. 8I depicts the sequences of the ASOs used in the experiments shown in FIG. 8G.

DETAILED DESCRIPTION OF THE INVENTION

Figure 1:
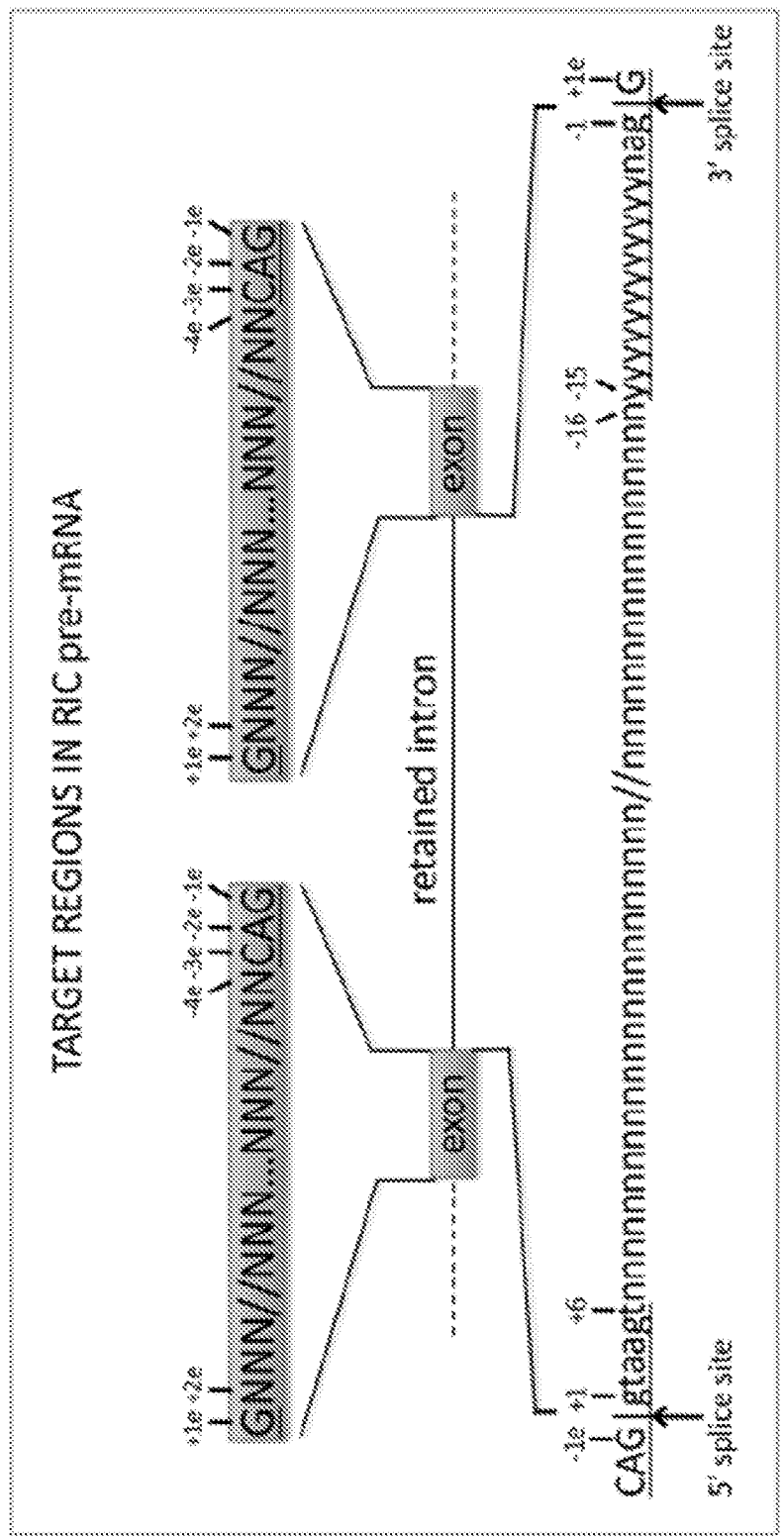
FIG. 1 depicts a schematic representation of an exemplary retained-intron-containing (RIC) pre-mRNA transcript.
Figure 2A:
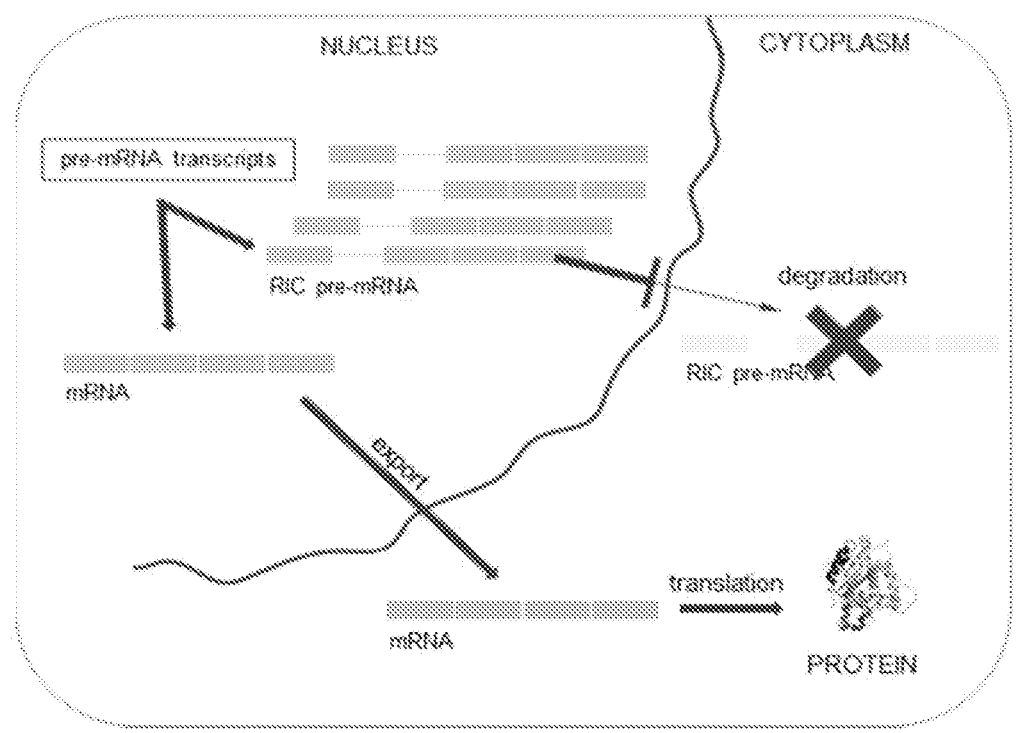
FIGS. 2A-B depict a schematic representation of the Targeted Augmentation of Nuclear Gene Output (TANGO) approach.
Figure 2B:
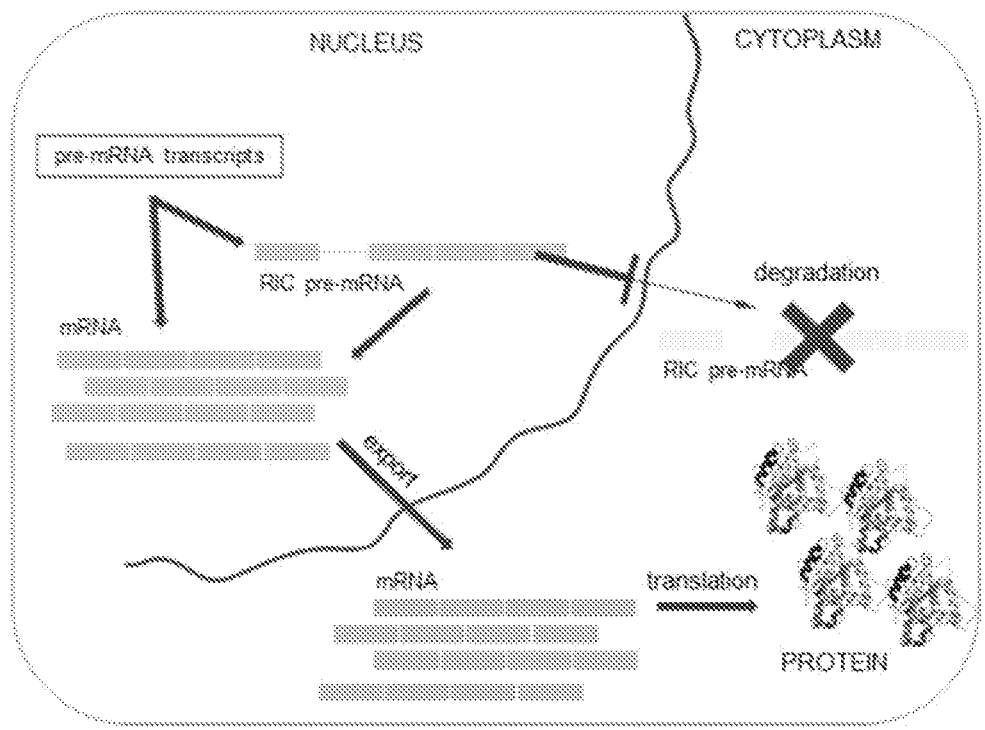

Individual introns in primary transcripts of protein-coding genes having more than one intron are spliced from the primary transcript with different efficiencies. In most cases only the fully spliced mRNA is exported through nuclear pores for subsequent translation in the cytoplasm. Unspliced and partially spliced transcripts are detectable in the nucleus. It is generally thought that nuclear accumulation of transcripts that are not fully spliced is a mechanism to prevent the accumulation of potentially deleterious mRNAs in the cytoplasm that may be translated to protein. For some genes, splicing of the least efficient intron is a rate-limiting post-transcriptional step in gene expression, prior to translation in the cytoplasm.

Substantial levels of partially-spliced transcripts encoding the SCN1A protein, deficient in AD mental retardation 5, and partially-spliced transcripts encoding the SYNGAP1 protein, deficient in Dravet syndrome, have been discovered in the nucleus of human cells. These SCN1A and SYNGAP1 pre-mRNA species comprise at least one retained intron. The present invention provides compositions and methods for upregulating splicing of one or more retained SYNGAP1 or SCN1A introns that are rate-limiting for the nuclear stages of gene expression to increase steady-state production of fully-spliced, mature mRNA, and thus, translated SYNGAP1 or SCN1A protein levels. These compositions and methods utilize antisense oligomers (ASOs) that promote constitutive splicing at intron splice sites of a retained-intron-containing SYNGAP1 or SCN1A pre-mRNA (RIC pre-mRNA) that accumulates in the nucleus. Thus, in embodiments, SYNGAP1 or SCN1A protein is increased using the methods of the invention to treat a condition caused by SYNGAP1 or SCN1A deficiency, respectively.

In other embodiments, the methods of the invention are used to increase SYNGAP1 or SCN1A production to treat a condition in a subject in need thereof. In embodiments, the subject has condition in which SYNGAP1 or SCN1A is not necessarily deficient relative to wild-type, but where an increase in SYNGAP1 or SCN1A mitigates the condition nonetheless. In embodiments, the condition is a caused by a SYNGAP1 or SCN1A haploinsufficiency.

Autosomal Dominant Mental Retardation 5

Mental retardation is the most frequently occurring severe handicap of children. The nonsyndromic form of the disorder is the most common, characterized by the absence of dysmorphic features. Monoallelic lesions are sufficient to cause the disorder that is characterized by global delay of development, hypotonia, and moderate to severe mental retardation. The genetic factors involved in nonsyndromic mental retardation remain poorly understood. Linkage and cytogenetic analyses have led to the identification of 29 X-linked and 5 autosomal recessive genes associated with nonsyndromic mental retardation, which together account for less than 10% of cases (Hamden, et al., 2009, incorporated herein by reference). Moreover, autosomal dominant genes have yet to be identified, which in turn decreases the likelihood of identifying families that are amenable to linkage analysis. However, the fact that de novo chromosomal rearrangements, usually involving a change in copy number of genomic regions, represent the most commonly recognized cause of mental retardation indicates that monoallelic lesions are sufficient to cause this disorder. This raises the possibility that smaller de novo genetic lesions, such as point mutations, also contribute to the pathogenesis of the disorder. A case study identified de novo genetic lesions in the SYNGAP1 gene that result in the production of truncated proteins in approximately 3% of patients with unexplained nonsyndromic mental retardation. The patients identified in the study were heterozygous for the protein-truncating mutations that comprised two nonsense mutations and one deletion (Hamdan, et al., 2009). The disease is described, e.g., at OMIM #612621 (Online Mendelian Inheritance in Man, Johns Hopkins University, 1966-2015), incorporated by reference herein.

SYNGAP1 is a GTPase-activating enzyme that is selectively expressed in the brain. A component of the N-methyl-D-aspartate (NMDA)-receptor complex that mediates glutamate signaling, SYNGAP1 acts downstream of the receptor, blocking insertion of the α-amino-3-hydroxy-5-methyl-4-isoxazole propionic acid (AMPA) receptor at the postsynaptic membrane by inhibiting the RAS-ERK signaling pathway. SYNGAP1 is required for normal development; mice homozygous for null alleles of the gene die shortly after birth. By contrast, mice heterozygous for the null allele have impaired synaptic plasticity and learning, consistent with the role of SYNGAP1 as a component of the NMDA-receptor complex (Hamdan, et al., 2009).

Alternative splicing of the SYNGAP1 gene results in the expression of three isoforms of SYNGAP1 (Hamdan, et al., 2009). SYNGAP1 possesses a RASGAP domain that activates Ras GTPases. A PDZ-binding motif, QTRV (SEQ ID NO: 2612), is present in isoform 2 that mediates interaction with other components of the NMDA-receptor complex. The RASGAP and QTRV (SEQ ID NO: 2612) domains regulate synaptic plasticity and dendritic-spine formation that are necessary for learning and development. Protein-truncating mutations associated with mental retardation lacked either the complete RASGAP domain or QTRV motifs (SEQ ID NO: 2612), consistent with their role in the pathogenesis of mental retardation.

Dravet Syndrome

Dravet syndrome (DS), otherwise known as severe myoclonic epilepsy of infancy (SMEI), is an epileptic encephalopathy presenting in the first year of life. Dravet syndrome is an increasingly recognized epileptic encephalopathy in which the clinical diagnosis is supported by the finding of sodium channel gene mutations in approximately 70-80% of patients. Mutations of ion channel genes play a major role in the pathogenesis of a range of epilepsy syndromes, resulting in some epilepsies being regarded as channelopathies. Voltage-gated sodium channels (VGSCs) play an essential role in neuronal excitability; therefore, it is not surprising that many mutations associated with DS have been identified in the gene encoding a VGSC subunit. The disease is described by, e.g., Mulley, et al., 2005, and the disease description at OMIM #607208 (Online Mendelian Inheritance in Man, Johns Hopkins University, 1966-2015), both incorporated by reference herein.

Between 70% and 80% of patients carry sodium channel al subunit gene (SCN1A) abnormalities, and truncating mutations account for about 40%, and have a significant correlation with an earlier age of seizures onset. Sequencing mutations are found in about 70% of cases and comprise truncating (40%) and missense mutations (40%) with the remaining being splice-site changes. Most mutations are de novo, but familial mutations occur in 5-10% of cases and are usually missense in nature. The remaining SCN1A mutations comprise splice-site and missense mutations, most of which fall into the pore-forming region of the sodium channel. At present, over 500 mutations have been associated with DS and are randomly distributed along the gene (Mulley, et al., Neurol. 2006, 67, 1094-1095).

The SCN1A gene is located in the cluster of sodium channel genes on human chromosome 2q24 and encodes the α-pore forming subunits known as Nav1.1 of the neuronal voltage gated sodium channel. The SCN1A gene spans approximately 100 kb of genomic DNA and comprises 26 exons. The SCN1A protein consists of four domains, each with six-transmembrane segments. Two splice variants have been identified that result in a long and short isoform that differ in the presence or absence of 11 amino acids in the cytoplasmic loop between domains 1 and 2, in exon 11 (Miller, et al., 1993-2015, and Mulley, et al., 2005, 25, 535-542, incorporated herein by reference).

The identification of genes associated with nonsyndromic mental retardation and Dravet syndrome that encode proteins in well-characterized synaptic pathways offers the possibility of developing pharmacologic treatments to target the disorders and reduce their associated symptoms.

Retained Intron Containing Pre-mRNA (RIC Pre-mRNA)

In embodiments, the methods of the present invention exploit the presence of retained-intron-containing pre-mRNA (RIC pre-mRNA) transcribed from the SYNGAP1 or SCN1A and encoding SYNGAP1 or SCN1A protein, in the cell nucleus. Splicing of the identified SYNGAP1 or SCN1A RIC pre-mRNA species to produce mature, fully-spliced, SYNGAP1 or SCN1A mRNA, is induced using ASOs that stimulate splicing out of the retained introns. The resulting mature SYNGAP1 or SCN1A mRNA can be exported to the cytoplasm and translated, thereby increasing the amount of SYNGAP1 or SCN1A protein in the patient's cells and alleviating symptoms of AD mental retardation or Dravet syndrome. This method, described further below, is known as Targeted Augmentation of Nuclear Gene Output (TANGO).

SYNGAP1 Nuclear Transcripts

As described herein in the Examples, the SYNGAP1 gene was analyzed for intron-retention events and retention of intron 15 and 18/19 was observed. RNA sequencing (RNAseq), visualized in the UCSC genome browser, showed SYNGAP1 transcripts expressed in human cortical neurons (HCN) and localized in either the cytoplasmic or nuclear fraction. In both fractions, reads were not observed for the majority of the introns. However, higher read density was detected for introns 15 and 18/19 in the nuclear fraction compared to the cytoplasmic fraction indicating that splicing efficiency of introns 15 and 18/19 is low, resulting in intron retention. The retained-intron containing pre-mRNA transcripts are retained in the nucleus and are not exported out to the cytoplasm. The read density for introns 18/19 indicated 42% intron retention. The percent intron retention (PIR) value for introns 18/19 was obtained by averaging four values (54, 50, 35, 29), each determined in HCN cells using one of four different algorithms. The read density for intron 15 indicated 25% intron retention. The percent intron retention (PIR) value for intron 15 was obtained by averaging four values (49, 0, 26 and 23), each determined in HCN cells using one of four different algorithms.

In some embodiments, the ASOs disclosed herein target a RIC pre-mRNA transcribed from a SCN1A genomic sequence. In some embodiments, the ASO targets a RIC pre-mRNA transcript from a SCN1A genomic sequence comprising retained intron 21. In some embodiments, the ASO targets a RIC pre-mRNA transcript from a SCN1A genomic sequence comprising retained intron 23. In some embodiments, the ASO targets a RIC pre-mRNA transcript of SEQ ID NO: 1. In some embodiments, the ASO targets a RIC pre-mRNA transcript of SEQ ID NO: 1 comprising a retained intron 21. In some embodiments, the ASO targets a RIC pre-mRNA transcript of SEQ ID NO: 1 comprising a retained intron 23. In some embodiments, the ASOs disclosed herein target a SCN1A RIC pre-mRNA sequence. In some embodiments, the ASO targets a SCN1A RIC pre-mRNA sequence comprising a retained intron 21. In some embodiments, the ASO targets a SCN1A RIC pre-mRNA sequence comprising a retained intron 23. In some embodiments, the ASO targets a SCN1A RIC pre-mRNA sequence according to any one of SEQ ID NOs: 4-7. In some embodiments, the ASO targets a SCN1A RIC pre-mRNA sequence according to any one of SEQ ID NOs: 4, 6, or 7 comprising a retained intron 21. In some embodiments, the ASO targets a SCN1A RIC pre-mRNA sequence according to SEQ ID NO: 5 comprising a retained intron 23. In some embodiments, the ASOs disclosed herein target SEQ ID NO: 2593. In some embodiments, the ASO has a sequence according to any one of SEQ ID NOs: 10-1037.

In some embodiments, the ASO targets exon 21 of a SCN1A RIC pre-mRNA comprising a retained intron 21. In some embodiments, the ASO targets an exon 21 sequence upstream (or 5') from the 5' splice site of a SCN1A RIC pre-mRNA comprising a retained intron 21. In some embodiments, the ASO targets an exon sequence about 4 to about 264 nucleotides upstream (or 5') from the 5' splice site of a SCN1A RIC pre-mRNA comprising a retained intron 21. In some embodiments, the ASO has a sequence according to any one of SEQ ID NOs: 10-62, 524-576, or 781-833.

In some embodiments, the ASO targets intron 21 in a SCN1A RIC pre-mRNA comprising a retained intron 21. In some embodiments, the ASO targets an intron 21 sequence downstream (or 3') from the 5' splice site of a SCN1A RIC pre-mRNA comprising a retained intron 21. In some embodiments, the ASO targets an intron 21 sequence about 6 to about 496 nucleotides downstream (or 3') from the 5' splice site of a SCN1A RIC pre-mRNA comprising a retained intron 21. In some embodiments, the ASO has a sequence according to any one of SEQ ID NOs: 63-161, 577-675, or 834-932.

In some embodiments, the ASO targets an intron 21 sequence upstream (or 5') from the 3' splice site of a SCN1A RIC pre-mRNA comprising a retained intron 21. In some embodiments, the ASO targets an intron 21 sequence about 16 to about 496 nucleotides upstream (or 5') from the 3' splice site of a SCN1A RIC pre-mRNA a comprising retained intron 21. In some embodiments, the ASO has a sequence according to any one of SEQ ID NOs: 162-258, 676-772, or 933-1029.

In some embodiments, the ASO targets exon 22 in a SCN1A RIC pre-mRNA comprising a retained intron 21. In some embodiments, the ASO targets an exon 22 sequence downstream (or 3') from the 3' splice site of a SCN1A RIC pre-mRNA comprising a retained intron 21. In some embodiments, the ASO targets an exon 22 sequence about 2 to about 37 nucleotides downstream (or 3') from the 3' splice site of a SCN1A RIC pre-mRNA comprising a retained intron 21. In some embodiments, the ASO has a sequence according to any one of SEQ ID NOs: 259-266, 773-780, or 1030-1037.

In some embodiments, the ASO targets exon 23 of a SCN1A RIC pre-mRNA comprising a retained intron 23. In some embodiments, the ASO targets an exon 23 sequence upstream (or 5') from the 5' splice site of a SCN1A RIC pre-mRNA comprising a retained intron 23. In some embodiments, the ASO targets an exon sequence about 4 to about 264 nucleotides upstream (or 5') from the 5' splice site of a SCN1A RIC pre-mRNA comprising a retained intron 23. In some embodiments, the ASO has a sequence according to any one of SEQ ID NOs: 267-319.

In some embodiments, the ASO targets intron 23 in a SCN1A RIC pre-mRNA comprising a retained intron 23. In some embodiments, the ASO targets an intron 23 sequence downstream (or 3') from the 5' splice site of a SCN1A RIC pre-mRNA comprising a retained intron 23. In some embodiments, the ASO targets an intron 23 sequence about 6 to about 496 nucleotides downstream (or 3') from the 5' splice site of a SCN1A RIC pre-mRNA comprising a retained intron 23. In some embodiments, the ASO has a sequence according to any one of SEQ ID NOs: 320-419.

In some embodiments, the ASO targets an intron 23 sequence upstream (or 5') from the 3' splice site of a SCN1A RIC pre-mRNA comprising a retained intron 23. In some embodiments, the ASO targets an intron 23 sequence about 16 to about 496 nucleotides upstream (or 5') from the 3' splice site of a SCN1A RIC pre-mRNA a comprising retained intron 23. In some embodiments, the ASO has a sequence according to any one of SEQ ID NOs: 420-515.

In some embodiments, the ASO targets exon 24 in a SCN1A RIC pre-mRNA comprising a retained intron 23. In some embodiments, the ASO targets an exon 24 sequence downstream (or 3') from the 3' splice site of a SCN1A RIC pre-mRNA comprising a retained intron 23. In some embodiments, the ASO targets an exon 24 sequence about 2 to about 37 nucleotides downstream (or 3') from the 3' splice site of a SCN1A RIC pre-mRNA comprising a retained intron 23. In some embodiments, the ASO has a sequence according to any one of SEQ ID NOs: 516-523.

In some embodiments, the ASOs disclosed herein target a RIC pre-mRNA transcribed from a SYNGAP1 genomic sequence. In some embodiments, the ASO targets a RIC pre-mRNA transcript from a SYNGAP1 genomic sequence comprising retained intron 18. In some embodiments, the ASO targets a RIC pre-mRNA transcript from a SYNGAP1 genomic sequence comprising retained intron 19. In some embodiments, the ASO targets a RIC pre-mRNA transcript from a SYNGAP1 genomic sequence comprising retained intron 15. In some embodiments, the ASO targets a RIC pre-mRNA transcript of SEQ ID NO: 2. In some embodiments, the ASO targets a RIC pre-mRNA transcript of SEQ ID NO: 3. In some embodiments, the ASO targets a RIC pre-mRNA transcript of SEQ ID NO: 2 comprising a retained intron 18. In some embodiments, the ASO targets a RIC pre-mRNA transcript of SEQ ID NO: 2 comprising a retained intron 19. In some embodiments, the ASO targets a RIC pre-mRNA transcript of SEQ ID NO: 2 comprising a retained intron 15. In some embodiments, the ASO targets a RIC pre-mRNA transcript of SEQ ID NO: 3 comprising a retained intron 18. In some embodiments, the ASO targets a RIC pre-mRNA transcript of SEQ ID NO: 3 comprising a retained intron 19. In some embodiments, the ASO targets a RIC pre-mRNA transcript of SEQ ID NO: 3 comprising a retained intron 15. In some embodiments, the ASOs disclosed herein target a SYNGAP1 RIC pre-mRNA sequence. In some embodiments, the ASO targets a SYNGAP1 RIC pre-mRNA sequence comprising a retained intron 18. In some embodiments, the ASO targets a SYNGAP1 RIC pre-mRNA sequence comprising a retained intron 19. In some embodiments, the ASO targets a SYNGAP1 RIC pre-mRNA sequence comprising a retained intron 15. In some embodiments, the ASO targets a SYNGAP1 RIC pre-mRNA sequence according to any one of SEQ ID NOs: 8-9. In some embodiments, the ASO targets a SYNGAP1 RIC pre-mRNA sequence according to any one of SEQ ID NOs: 8-9 comprising a retained intron 18. In some embodiments, the ASO targets a SYNGAP1 RIC pre-mRNA sequence according to any one of SEQ ID NOs: 8-9 comprising a retained intron 19. In some embodiments, the ASO targets a SYNGAP1 RIC pre-mRNA sequence according to any one of SEQ ID NOs: 8-9 comprising a retained intron 15. In some embodiments, the ASOs disclosed herein target any one of SEQ ID NOs: 2592, 2594, or 2595. In some embodiments, the ASO has a sequence according to any one of SEQ ID NOs: 1038-2591.

In some embodiments, the ASO targets an exon sequence of a SYNGAP1 RIC pre-mRNA comprising a retained intron 18 or intron 19. In some embodiments, the ASO targets an exon sequence upstream (or 5') from the 5' splice site of a SYNGAP1 RIC pre-mRNA comprising a retained intron 18 or intron 19. In some embodiments, the ASO targets an exon sequence about 4 to about 73 nucleotides upstream (or 5') from the 5' splice site of a SYNGAP1 RIC pre-mRNA comprising a retained intron 18 or intron 19. In some embodiments, the ASO has a sequence according to any one of SEQ ID NOs: 1038-1050 or 1815-1827.

In some embodiments, the ASO targets intron 18 or intron 19 in a SYNGAP1 RIC pre-mRNA comprising a retained intron 18 or intron 19. In some embodiments, the ASO targets a sequence downstream (or 3') from the 5' splice site of a SYNGAP1 RIC pre-mRNA comprising a retained intron 18 or intron 19. In some embodiments, the ASO targets a sequence about 6 to about 499 nucleotides downstream (or 3') from the 5' splice site of a SYNGAP1 RIC pre-mRNA comprising a retained intron 18 or intron 19. In some embodiments, the ASO has a sequence according to any one of SEQ ID NOs: 1051-1136 or 1828-1913.

In some embodiments, the ASO targets an intron 18 or intron 19 sequence upstream (or 5') from the 3' splice site of a SYNGAP1 RIC pre-mRNA comprising a retained intron 18 or intron 19. In some embodiments, the ASO targets a sequence about 16 to about 496 nucleotides upstream (or 5') from the 3' splice site of a SYNGAP1 RIC pre-mRNA a comprising retained intron 18 or intron 19. In some embodiments, the ASO has a sequence according to any one of SEQ ID NOs: 1137-1228 or 1914-2005.

In some embodiments, the ASO targets an exon sequence in a SYNGAP1 RIC pre-mRNA comprising a retained intron 18 or intron 19. In some embodiments, the ASO targets an exon sequence downstream (or 3') from the 3' splice site of a SYNGAP1 RIC pre-mRNA comprising a retained intron 18 or intron 19. In some embodiments, the ASO targets an exon sequence about 17 to about 1,912 nucleotides downstream (or 3') from the 3' splice site of a SYNGAP1 RIC pre-mRNA comprising a retained intron 18 or intron 19. In some embodiments, the ASO has a sequence according to any one of SEQ ID NOs: 1229-1509 or 2006-2286.

In some embodiments, the ASO targets exon 15 of a SYNGAP1 RIC pre-mRNA comprising a retained intron 15. In some embodiments, the ASO targets an exon 15 sequence upstream (or 5') from the 5' splice site of a SYNGAP1 RIC pre-mRNA comprising a retained intron 15. In some embodiments, the ASO targets an exon sequence about 4 to about 1,054 nucleotides upstream (or 5') from the 5' splice site of a SYNGAP1 RIC pre-mRNA comprising a retained intron 15. In some embodiments, the ASO has a sequence according to any one of SEQ ID NOs: 1510-1686 or 2287-2463.

In some embodiments, the ASO targets intron 15 in a SYNGAP1 RIC pre-mRNA comprising a retained intron 15. In some embodiments, the ASO targets an intron 15 sequence downstream (or 3') from the 5' splice site of a SYNGAP1 RIC pre-mRNA comprising a retained intron 15. In some embodiments, the ASO targets an intron 15 sequence about 6 to about 251 nucleotides downstream (or 3') from the 5' splice site of a SYNGAP1 RIC pre-mRNA comprising a retained intron 15. In some embodiments, the ASO has a sequence according to any one of SEQ ID NOs: 1687-1736 or 2464-2513.

In some embodiments, the ASO targets an intron 15 sequence upstream (or 5') from the 3' splice site of a SYNGAP1 RIC pre-mRNA comprising a retained intron 15. In some embodiments, the ASO targets an intron 15 sequence about 16 to about 256 nucleotides upstream (or 5') from the 3' splice site of a SYNGAP1 RIC pre-mRNA a comprising retained intron 15. In some embodiments, the ASO has a sequence according to any one of SEQ ID NOs: 1737-1785 or 2514-2562.

In some embodiments, the ASO targets exon 16 in a SYNGAP1 RIC pre-mRNA comprising a retained intron 15. In some embodiments, the ASO targets an exon 16 sequence downstream (or 3') from the 3' splice site of a SYNGAP1 RIC pre-mRNA comprising a retained intron 15. In some embodiments, the ASO targets an exon 16 sequence about 2 to about 157 nucleotides downstream (or 3') from the 3' splice site of a SYNGAP1 RIC pre-mRNA comprising a retained intron 15. In some embodiments, the ASO has a sequence according to any one of SEQ ID NOs: 1786-1814 or 2563-2591.

In embodiments, the targeted portion of the SYNGAP1 RIC pre-mRNA is in intron 15, 18, or 19. The SYNGAP1 intron numbering used herein corresponds to the mRNA sequence at NM_006772.2. In embodiments, hybridization of an ASO to the targeted portion of the RIC pre-mRNA results in enhanced splicing at the splice site (5' splice site or 3' splice site) of at least one of retained introns 15, 18, or 19, and subsequently increases SYNGAP1 protein production. It is understood that the intron numbering may change in reference to a different SYNGAP1 isoform sequence. One of skill in the art can determine the corresponding intron number in any isoform based on an intron sequence provided herein or using the number provided in reference to the mRNA sequence at NM_006772.2. One of skill in the art also can determine the sequences of flanking exons in any SYNGAP1 isoform for targeting using the methods of the invention, based on an intron sequence provided herein or using the intron number provided in reference to the mRNA sequence at NM_006772.2.

In embodiments, the targeted portion of the SCN1A RIC pre-mRNA is in intron 1, 2, 3, 4, 5, 6, 7, 8, 9, 10, 11, 12, 13, 14, 15, 16, 17, 18, 19, 20, 21, 22, 23, 24, or 25 (intron numbering corresponding to the mRNA sequence at NM_001202435.1). In embodiments, hybridization of an ASO to the targeted portion of the RIC pre-mRNA results in enhanced splicing at the splice site (5' splice site or 3' splice site) of at least one of retained introns 1, 2, 3, 4, 5, 6, 7, 8, 9, 10, 11, 12, 13, 14, 15, 16, 17, 18, 19, 20, 21, 22, 23, 24, or 25, and subsequently increases SCN1A protein production. In embodiments, the targeted portion of the SCN1A RIC pre-mRNA is in intron 21 or 23. One of skill in the art can determine the corresponding intron number in any isoform based on an intron sequence provided herein or using the number provided in reference to the mRNA sequence at NM_006920, NM_001202435, NM_001165964, or NM_001165963. One of skill in the art also can determine the sequences of flanking exons in any SCN1A isoform for targeting using the methods of the invention, based on an intron sequence provided herein or using the intron number provided in reference to the mRNA sequence at NM_006920, NM_001202435, NM_001165964, or NM_001165963.

The degree of intron retention can be expressed as percent intron retention (PIR), the percentage of transcripts in which a given intron is retained. In brief, PIR can be calculated as the percentage of the average number of reads mapping to the exon-intron junctions, over the sum of the average of the exon-intron junction reads plus the exon-exon junction reads.

PIR values for SCN1A have been reported, e.g., by Braunschweig, et al., 2014, (see, e.g., Supplemental Table S9), incorporated by reference herein in its entirety. In embodiments, the methods and compositions of the invention are used to increase the expression of SCN1A by inducing constitutive splicing of a retained intron of an SCN1A RIC-pre-mRNA. In embodiments, the retained intron is any of introns 1-25. In embodiments, the retained intron is any of introns 2, 4, 6, 13, 14, 15, 16, 17, 18, 20, 21, 22, 23, 24, and 25. In embodiments, the retained intron is any of introns 15, 18, and 19. In embodiments, the retained intron can be any SCN1A intron. In embodiments, the retained intron is intron 21. In embodiments, the retained intron is intron 23. The SCN1A intron numbering used herein corresponds to the mRNA sequence at NM_001202435.1. It is understood that the intron numbering may change in reference to a different SCN1A isoform sequence.

SYNGAP1 or SCN1A Protein Expression

As described above, SYNGAP1 mutations in AD nonsyndromic mental retardation are spread across the entire protein, and there is a high de novo mutation rate. Linkage and cytogenetic analysis have identified 29 X-linked and 5 autosomal recessive genes associated with AD nonsyndromic mental retardation, which account for less than 10% of cases. This suggests that smaller de novo genetic lesions, such as point mutations, may contribute to disease pathogenesis.

Also described above, SCN1A mutations in Dravet Syndrome are spread across the entire protein. More than 100 novel mutations have been identified throughout the gene with the more debilitating arising de novo. These comprise of truncations (47%), missense (43%), deletions (3%), and splice site mutations (7%). The percentage of subjects carrying SCN1A mutations varies between 33 and 100%. The majority of mutations are novel changes (88%).

In embodiments, the methods described herein are used to increase the production of a functional SYNGAP1 or SCN1A protein. As used herein, the term "functional" refers to the amount of activity or function of a SYNGAP1 or SCN1A protein that is necessary to eliminate any one or more symptoms of a treated condition, e.g., AD mental retardation 5 or Dravet syndrome. In embodiments, the methods are used to increase the production of a partially functional SYNGAP1 or SCN1A protein. As used herein, the term "partially functional" refers to any amount of activity or function of the SYNGAP1 or SCN1A protein that is less than the amount of activity or function that is necessary to eliminate or prevent any one or more symptoms of a disease or condition. In some embodiments, a partially functional protein or RNA will have at least 10%, at least 20%, at least 30%, at least 40%, at least 50%, at least 60%, at least 70%, at least 75%, at least 80%, at least 85%, at least 90%, or at least 95% less activity relative to the fully functional protein or RNA.

In embodiments, the method is a method of increasing the expression of the SYNGAP1 or SCN1A protein by cells of a subject having a RIC pre-mRNA encoding the SYNGAP1 or SCN1A protein, wherein the subject has AD mental retardation 5 or Dravet syndrome caused by a deficient amount of activity of SYNGAP1 or SCN1A protein, and wherein the deficient amount of the SYNGAP1 or SCN1A protein is caused by haploinsufficiency of the SYNGAP1 or SCN1A protein. In such an embodiment, the subject has a first allele encoding a functional SYNGAP1 or SCN1A protein, and a second allele from which the SYNGAP1 or SCN1A protein is not produced. In another such embodiment, the subject has a first allele encoding a functional SYNGAP1 or SCN1A protein, and a second allele encoding a nonfunctional SYNGAP1 or SCN1A protein. In another such embodiment, the subject has a first allele encoding a functional SYNGAP1 or SCN1A protein, and a second allele encoding a partially functional SYNGAP1 or SCN1A protein. In any of these embodiments, the antisense oligomer binds to a targeted portion of the RIC pre-mRNA transcribed from the first allele (encoding functional SYNGAP1 or SCN1A protein), thereby inducing constitutive splicing of the retained intron from the RIC pre-mRNA, and causing an increase in the level of mature mRNA encoding functional SYNGAP1 or SCN1A protein, and an increase in the expression of the SYNGAP1 or SCN1A protein in the cells of the subject.

In embodiments, the subject has a first allele encoding a functional SYNGAP1 or SCN1A protein, and a second allele encoding a partially functional SYNGAP1 or SCN1A protein, and the antisense oligomer binds to a targeted portion of the RIC pre-mRNA transcribed from the first allele (encoding functional SYNGAP1 or SCN1A protein) or a targeted portion of the RIC pre-mRNA transcribed from the second allele (encoding partially functional SYNGAP1 or SCN1A protein), thereby inducing constitutive splicing of the retained intron from the RIC pre-mRNA, and causing an increase in the level of mature mRNA encoding the SYNGAP1 or SCN1A protein, and an increase in the expression of functional or partially functional SYNGAP1 or SCN1A protein in the cells of the subject.

In related embodiments, the method is a method of using an ASO to increase the expression of a protein or functional RNA. In embodiments, an ASO is used to increase the expression of SYNGAP1 or SCN1A protein in cells of a subject having a RIC pre-mRNA encoding SYNGAP1 or SCN1A protein, wherein the subject has a deficiency, e.g., AD mental retardation 5 or Dravet syndrome, in the amount or function of a SYNGAP1 or SCN1A protein.

In embodiments, the RIC pre-mRNA transcript that encodes the protein that is causative of the disease or condition is targeted by the ASOs described herein. In some embodiments, a RIC pre-mRNA transcript that encodes a protein that is not causative of the disease is targeted by the ASOs. For example, a disease that is the result of a mutation or deficiency of a first protein in a particular pathway may be ameliorated by targeting a RIC pre-mRNA that encodes a second protein, thereby increasing production of the second protein. In some embodiments, the function of the second protein is able to compensate for the mutation or deficiency of the first protein (which is causative of the disease or condition).

In embodiments, the subject has:
(a) a first mutant allele from which
  (i) the SYNGAP1 or SCN1A protein is produced at a reduced level compared to production from a wild-type allele,
  (ii) the SYNGAP1 or SCN1A protein is produced in a form having reduced function compared to an equivalent wild-type protein, or
  (iii) the SYNGAP1 or SCN1A protein or functional RNA is not produced; and
(b) a second mutant allele from which
  (i) the SYNGAP1 or SCN1A protein is produced at a reduced level compared to production from a wild-type allele, (ii) the SYNGAP1 or SCN1A protein is produced in a form having reduced function compared to an equivalent wild-type protein, or (iii) the SYNGAP1 or SCN1A protein is not produced, and wherein the RIC pre-mRNA is transcribed from the first allele and/or the second allele. In these embodiments, the ASO binds to a targeted portion of the RIC pre-mRNA transcribed from the first allele or the second allele, thereby inducing constitutive splicing of the retained intron from the RIC pre-mRNA, and causing an increase in the level of mRNA encoding SYNGAP1 or SCN1A protein and an increase in the expression of the target protein or functional RNA in the cells of the subject. In these embodiments, the target protein or functional RNA having an increase in expression level resulting from the constitutive splicing of the retained intron from the RIC pre-mRNA is either in a form having reduced function compared to the equivalent wild-type protein (partially-functional), or having full function compared to the equivalent wild-type protein (fully-functional).

In embodiments, the level of mRNA encoding SYNGAP1 or SCN1A protein is increased 1.1 to 10-fold, when compared to the amount of mRNA encoding SYNGAP1 or SCN1A protein that is produced in a control cell, e.g., one that is not treated with the antisense oligomer or one that is treated with an antisense oligomer that does not bind to the targeted portion of the SYNGAP1 or SCN1A RIC pre-mRNA.

In embodiments, the condition caused by a deficient amount or activity of SYNGAP1 or SCN1A protein is not a condition caused by alternative or aberrant splicing of the retained intron to which the ASO is targeted. In embodiments, the condition caused by a deficient amount or activity of the SYNGAP1 or SCN1A protein is not a condition caused by alternative or aberrant splicing of any retained intron in a RIC pre-mRNA encoding the SYNGAP1 or SCN1A protein. In embodiments, alternative or aberrant splicing may occur in a pre-mRNA transcribed from the SYNGAP1 or SCN1A gene, however the compositions and methods of the invention do not prevent or correct this alternative or aberrant splicing.

In embodiments, a subject treated using the methods of the invention expresses a partially functional SYNGAP1 or SCN1A protein from one allele, wherein the partially functional SYNGAP1 or SCN1A protein is caused by a frameshift mutation, a nonsense mutation, a missense mutation, or a partial gene deletion. In embodiments, a subject treated using the methods of the invention expresses a nonfunctional SYNGAP1 or SCN1A protein from one allele, wherein the nonfunctional SYNGAP1 or SCN1A protein is caused by a frameshift mutation, a nonsense mutation, a missense mutation, a partial gene deletion, in one allele. In embodiments, a subject treated using the methods of the invention has a SYNGAP1 or SCN1A whole gene deletion, in one allele.

In embodiments, a subject has a SYNGAP1 or SCN1A missense mutation. A subject can have a SYNGAP1 and a SCN1A mutation. In some cases, a SYNGAP1 mutation can be a truncating mutation. A SYNGAP1 truncating mutation can be a K138X, R579X, or L813RfsX22 mutation. A K138X mutation can result in a truncated SYNGAP1 protein that may lack a RASGAP domain. Said K138X mutation can encode a c.412A→T mutation. In some cases, a R579X mutation may truncate SYNGAP1 in a region following a RASGAP domain. In embodiments, a c.2438delT may also truncate SYNGAP1 in a region following a RASGAP domain. In some cases, a L813RfsX22 mutation may encode a c.2438delT sequence of mutation. Said mutations can occur upstream of the 3' terminus of a SYNGAP1 gene that can be alternatively spliced. In embodiments, mutations in said 3' terminus may alter the encoding of a C-terminal portion of SYNGAP1 protein.

The present invention also discloses a splicing process that can produce at least three isoforms of said SYNGAP1. Isoforms of the present invention may also be mutated. In some cases, a SYNGAP1 isoform can consist of at least 1343 amino acids. An isoform may comprise functional domains. A first SYNGAP1 isoform can contain functional domains that are mutated. A SYNGAP1 isoform can have a pleckstrin homology domain, a C2 domain, RASGAP, SH3, CC domain, and a CamKII binding domain. A K138X mutation can be upstream of a pleckstrin homology domain. A K138X mutation can be within a pleckstrin homology domain. A K138X mutation can be downstream of a pleckstrin homology domain. A R579X mutation can be in a region of a RASGAP domain. A R579X mutation can also be adjacent to a RASGAP domain. Similarly, a L813RfsX22 mutation can be adjacent to a SH3 SYNGAP1 domain. A L813RfsX22 mutation can also be within a SH3 SYNGAP1 domain.

In embodiments, a mutation can also be present on a second or third isoform of said SYNGAP1.

In embodiments, a subject can have a mutation that is not determined. A mutation that is not determined may be a SYNGAP1 mutation or a SCN1A mutation. A mutation that is not determined may be a SYNGAP1 mutation. In some cases, a SYNGAP1 mutation can be I1115T. Said, I1115T mutation may code a c.3344T→C mutation. In certain embodiments, mutations in SYNGAP1 may be associated with diseases that are not nonsyndromic mental retardation. Mutations in SYNGAP1 can be associated with autism spectrum disorders and schizophrenia. In some cases, mutations that are associated with SYNGAP1 can be a polymorphism.

In embodiments of the present invention, a subject can have a mutation in SCN1A. Mutations in SCN1A can be spread throughout said gene. SCN1A protein can consist of four domains. Said SCN1A domains can have transmembrane segments. Mutations in said SCN1A protein may arise throughout said protein. Said SCN1A protein may consist of at least two isoforms. Mutations in SCN1A may comprise of R931C, R946C, M934I, R1648C, or R1648H. In some cases, mutations may be observed in a C-terminus of a SCN1A protein. Mutations in a SCN1A protein may also be found in loops between segments 5 and 6 of the first three domains of said SCN1A protein. In some cases, mutations may be observed in an N-terminus of a SCN1A protein. Mutations within SCN1A can be R222X, R712X, I227S, R1892X, W952X, R1245X, R1407X, W1434R, c.4338+1G>A, 51516X, L1670fsX1678, or K1846fsX1856. Mutations that can be targeted with the present invention may also encode a pore of an ion channel.

In embodiments, the present invention can be used to treat Dravet syndrome. In other embodiments, the present invention can be used to treat severe myclonic epilepsy of infancy (SMEI). In other embodiments, the present invention can treat borderline Dravet syndrome. The present invention can also treat borderline SMEI. Additionally, the present invention can treat generalized epilepsy with febrile seizures plus (GEFS+). GEFS+ may be associated with mutations in epilepsy-associated ion channel subunits such as SCN1B or GABRG2. The present invention can also treat sodium channelopathies. Sodium channelopathies may be associated with mutations in SCN1A. Sodium channelopathies may also be associated with subunits of said SCN1A, such as the beta subunit, SCN1B. In some cases, additional diseases associated with SCN1A mutations may also be treated with the present invention. Related SCN1A diseases associated with SCN1A mutations can be atypical myotonia congenita, hyperkalemic periodic paralysis, or paramyotonia congenita.

In embodiments, a subject having any SYNGAP1 or SCN1A mutation known in the art and described in the literature referenced above (e.g., by Hamdan, et al., 2009, Mulley, et al., 2005) is treated using the methods and compositions of the present invention. In embodiments, the mutation can be within any SYNGAP1 or SCN1A intron.

Use of TANGO for Increasing SYNGAP1 or SCN1A Protein Expression

As described above, in embodiments, Targeted Augmentation of Nuclear Gene Output (TANGO) is used in the methods of the invention to increase expression of a SYNGAP1 or SCN1A protein. In these embodiments, a retained-intron-containing pre-mRNA (RIC pre-mRNA) encoding SYNGAP1 or SCN1A protein is present in the nucleus of a cell. Cells having a SYNGAP1 or SCN1A RIC pre-mRNA that comprises a retained intron, an exon flanking the 5' splice site, and an exon flanking the 3' splice site, encoding the SYNGAP1 or SCN1A protein, are contacted with antisense oligomers (ASOs) that are complementary to a targeted portion of the RIC pre-mRNA. Hybridization of the ASOs to the targeted portion of the RIC pre-mRNA results in enhanced splicing at the splice site (5' splice site or 3' splice site) of the retained intron and subsequently increases target protein production.

The terms "pre-mRNA," and "pre-mRNA transcript" may be used interchangeably and refer to any pre-mRNA species that contains at least one intron. In embodiments, pre-mRNA or pre-mRNA transcripts comprise a 5'-7-methylguanosine cap and/or a poly-A tail. In embodiments, pre-mRNA or pre-mRNA transcripts comprise both a 5'-7-methylguanosine cap and a poly-A tail. In some embodiments, the pre-mRNA transcript does not comprise a 5'-7-methylguanosine cap and/or a poly-A tail. A pre-mRNA transcript is a non-productive messenger RNA (mRNA) molecule if it is not translated into a protein (or transported into the cytoplasm from the nucleus).

As used herein, a "retained-intron-containing pre-mRNA" ("RIC pre-mRNA") is a pre-mRNA transcript that contains at least one retained intron. The RIC pre-mRNA contains a retained intron, an exon flanking the 5' splice site of the retained intron, an exon flanking the 3' splice site of the retained intron, and encodes the target protein. An "RIC pre-mRNA encoding a target protein" is understood to encode the target protein when fully spliced. A "retained intron" is any intron that is present in a pre-mRNA transcript when one or more other introns, such as an adjacent intron, encoded by the same gene have been spliced out of the same pre-mRNA transcript. In some embodiments, the retained intron is the most abundant intron in RIC pre-mRNA encoding the target protein. In embodiments, the retained intron is the most abundant intron in a population of RIC pre-mRNAs transcribed from the gene encoding the target protein in a cell, wherein the population of RIC pre-mRNAs comprises two or more retained introns. In embodiments, an antisense oligomer targeted to the most abundant intron in the population of RIC pre-mRNAs encoding the target protein induces splicing out of two or more retained introns in the population, including the retained intron to which the antisense oligomer is targeted or binds. In embodiments, a mature mRNA encoding the target protein is thereby produced. The terms "mature mRNA," and "fully-spliced mRNA," are used interchangeably herein to describe a fully processed mRNA encoding a target protein (e.g., mRNA that is exported from the nucleus into the cytoplasm and translated into target protein) or a fully processed functional RNA. The term "productive mRNA," also can be used to describe a fully processed mRNA encoding a target protein. In embodiments, the targeted region is in a retained intron that is the most abundant intron in a RIC pre-mRNA encoding the SYNGAP1 or SCN1A protein. In embodiments, the most retained intron in a RIC pre-mRNA encoding the SYNGAP1 protein is intron 18/19. In embodiments, the most retained intron in a RIC pre-mRNA encoding the SYNGAP1 protein is intron 15.

In embodiments, a retained intron is an intron that is identified as a retained intron based on a determination of at least about 5%, at least about 10%, at least about 15%, at least about 20%, at least about 25%, at least about 30%, at least about 35%, at least about 40%, at least about 45%, or at least about 50%, retention. In embodiments, a retained intron is an intron that is identified as a retained intron based on a determination of about 5% to about 100%, about 5% to about 95%, about 5% to about 90%, about 5% to about 85%, about 5% to about 80%, about 5% to about 75%, about 5% to about 70%, about 5% to about 65%, about 5% to about 60%, about 5% to about 55%, about 5% to about 50%, about 5% to about 45%, about 5% to about 40%, about 5% to about 35%, about 5% to about 30%, about 5% to about 25%, about 5% to about 20%, about 5% to about 15%, about 10% to about 100%, about 10% to about 95%, about 10% to about 90%, about 10% to about 85%, about 10% to about 80%, about 10% to about 75%, about 10% to about 70%, about 10% to about 65%, about 10% to about 60%, about 10% to about 55%, about 10% to about 50%, about 10% to about 45%, about 10% to about 40%, about 10% to about 35%, about 10% to about 30%, about 10% to about 25%, about 10% to about 20%, about 15% to about 100%, about 15% to about 95%, about 15% to about 90%, about 15% to about 85%, about 15% to about 80%, about 15% to about 75%, about 15% to about 70%, about 15% to about 65%, about 15% to about 60%, about 15% to about 55%, about 15% to about 50%, about 15% to about 45%, about 15% to about 40%, about 15% to about 35%, about 15% to about 30%, about 15% to about 25%, about 20% to about 100%, about 20% to about 95%, about 20% to about 90%, about 20% to about 85%, about 20% to about 80%, about 20% to about 75%, about 20% to about 70%, about 20% to about 65%, about 20% to about 60%, about 20% to about 55%, about 20% to about 50%, about 20% to about 45%, about 20% to about 40%, about 20% to about 35%, about 20% to about 30%, about 25% to about 100%, about 25% to about 95%, about 25% to about 90%, about 25% to about 85%, about 25% to about 80%, about 25% to about 75%, about 25% to about 70%, about 25% to about 65%, about 25% to about 60%, about 25% to about 55%, about 25% to about 50%, about 25% to about 45%, about 25% to about 40%, or about 25% to about 35%, retention. ENCODE data (described by, e.g., Tilgner, et al., 2012, "Deep sequencing of subcellular RNA fractions shows splicing to be predominantly co-transcriptional in the human genome but inefficient for lncRNAs," Genome Research 22(9):1616-25) can be used to aid in identifying retained introns.

As used herein, the term "comprise" or variations thereof such as "comprises" or "comprising" are to be read to indicate the inclusion of any recited feature (e.g., in the case of an antisense oligomer, a defined nucleobase sequence) but not the exclusion of any other features. Thus, as used herein, the term "comprising" is inclusive and does not exclude additional, unrecited features (e.g., in the case of an antisense oligomer, the presence of additional, unrecited nucleobases).

In embodiments of any of the compositions and methods provided herein, "comprising" may be replaced with "consisting essentially of" or "consisting of" The phrase "consisting essentially of" is used herein to require the specified feature(s) (e.g., nucleobase sequence) as well as those which do not materially affect the character or function of the claimed invention. As used herein, the term "consisting" is used to indicate the presence of the recited feature (e.g., nucleobase sequence) alone (so that in the case of an antisense oligomer consisting of a specified nucleobase sequence, the presence of additional, unrecited nucleobases is excluded).

In embodiments, the targeted region is in a retained intron that is the second most abundant intron in a RIC pre-mRNA encoding the SYNGAP1 or SCN1A protein. For example, the second most abundant retained intron may be targeted rather than the most abundant retained intron due to the uniqueness of the nucleotide sequence of the second most abundant retained intron, ease of ASO design to target a particular nucleotide sequence, and/or amount of increase in protein production resulting from targeting the intron with an ASO. In embodiments, the retained intron is the second most abundant intron in a population of RIC pre-mRNAs transcribed from the gene encoding the target protein in a cell, wherein the population of RIC pre-mRNAs comprises two or more retained introns. In embodiments, an antisense oligomer targeted to the second most abundant intron in the population of RIC pre-mRNAs encoding the target protein induces splicing out of two or more retained introns in the population, including the retained intron to which the antisense oligomer is targeted or binds. In embodiments, fully-spliced (mature) RNA encoding the target protein is thereby produced. In embodiments, the second-most retained intron in a RIC pre-mRNA encoding the SYNGAP1 protein is intron 15. In embodiments, the second-most retained intron in a RIC pre-mRNA encoding the SYNGAP1 protein is intron 18/19.

In embodiments, an ASO is complementary to a targeted region that is within a non-retained intron in a RIC pre-mRNA. In embodiments, the targeted portion of the RIC pre-mRNA is within: the region +6 to +100 relative to the 5' splice site of the non-retained intron; or the region −16 to −100 relative to the 3' splice site of the non-retained intron. In embodiments, the targeted portion of the RIC pre-mRNA is within the region +100 relative to the 5' splice site of the non-retained intron to −100 relative to the 3' splice site of the non-retained intron. As used to identify the location of a region or sequence, "within" is understood to include the residues at the positions recited. For example, a region +6 to +100 includes the residues at positions +6 and +100. In embodiments, fully-spliced (mature) RNA encoding the target protein is thereby produced.

In embodiments, the retained intron of the RIC pre-mRNA is an inefficiently spliced intron. As used herein, "inefficiently spliced" may refer to a relatively low frequency of splicing at a splice site adjacent to the retained intron (5' splice site or 3' splice site) as compared to the frequency of splicing at another splice site in the RIC pre-mRNA. The term "inefficiently spliced" may also refer to the relative rate or kinetics of splicing at a splice site, in which an "inefficiently spliced" intron may be spliced or removed at a slower rate as compared to another intron in a RIC pre-mRNA.

In embodiments, the 9-nucleotide sequence at −3e to −1e of the exon flanking the 5' splice site and +1 to +6 of the retained intron is identical to the corresponding wild-type sequence. In embodiments, the 16 nucleotide sequence at −15 to −1 of the retained intron and +1e of the exon flanking the 3' splice site is identical to the corresponding wild-type sequence. As used herein, the "wild-type sequence" refers to the nucleotide sequence for SYNGAP1 or SCN1A in the published reference genome deposited in the NCBI repository of biological and scientific information (operated by National Center for Biotechnology Information, National Library of Medicine, 8600 Rockville Pike, Bethesda, Md. USA 20894). Also used herein, a nucleotide position denoted with an "e" indicates the nucleotide is present in the sequence of an exon (e.g., the exon flanking the 5' splice site or the exon flanking the 3' splice site). As used herein, the "wild-type sequence" refers to the canonical sequence available at NCBI Gene ID 8831 for SYNGAP, and NCBI GENE ID 6323 for SCN1A.

The methods involve contacting cells with an ASO that is complementary to a portion of a pre-mRNA encoding SYNGAP1 or SCN1A protein, resulting in increased expression of SYNGAP1 or SCN1A. As used herein, "contacting" or administering to cells refers to any method of providing an ASO in immediate proximity with the cells such that the ASO and the cells interact. A cell that is contacted with an ASO will take up or transport the ASO into the cell. The method involves contacting a condition or disease-associated or condition or disease-relevant cell with any of the ASOs described herein. In some embodiments, the ASO may be further modified or attached (e.g., covalently attached) to another molecule to target the ASO to a cell type, enhance contact between the ASO and the condition or disease-associated or condition or disease-relevant cell, or enhance uptake of the ASO.

As used herein, the term "increasing protein production" or "increasing expression of a target protein" means enhancing the amount of protein that is translated from an mRNA in a cell. A "target protein" may be any protein for which increased expression/production is desired.

In embodiments, contacting a cell that expresses a SYNGAP1 or SCN1A RIC pre-mRNA with an ASO that is complementary to a targeted portion of the SYNGAP1 or SCN1A RIC pre-mRNA transcript results in a measurable increase in the amount of the SYNGAP1 or SCN1A protein (e.g., a target protein) encoded by the pre-mRNA. Methods of measuring or detecting production of a protein will be evident to one of skill in the art and include any known method, for example, Western blotting, flow cytometry, immunofluorescence microscopy, and ELISA.

In embodiments, contacting cells with an ASO that is complementary to a targeted portion of a SYNGAP1 or SCN1A RIC pre-mRNA transcript results in an increase in the amount of SYNGAP1 or SCN1A protein produced by at least 10, 20, 30, 40, 50, 60, 80, 100, 150, 200, 250, 300, 350, 400, 450, 500, or 1000%, compared to the amount of the protein produced by a cell in the absence of the ASO/absence of treatment. In embodiments, the total amount of SYNGAP1 or SCN1A protein produced by the cell to which the antisense oligomer was contacted is increased about 1.1 to about 10-fold, about 1.5 to about 10-fold, about 2 to about 10-fold, about 3 to about 10-fold, about 4 to about 10-fold, about 1.1 to about 5-fold, about 1.1 to about 6-fold, about 1.1 to about 7-fold, about 1.1 to about 8-fold, about 1.1 to about 9-fold, about 2 to about 5-fold, about 2 to about 6-fold, about 2 to about 7-fold, about 2 to about 8-fold, about 2 to about 9-fold, about 3 to about 6-fold, about 3 to about 7-fold, about 3 to about 8-fold, about 3 to about 9-fold, about 4 to about 7-fold, about 4 to about 8-fold, about 4 to about 9-fold, at least about 1.1-fold, at least about 1.5-fold, at least about 2-fold, at least about 2.5-fold, at least about 3-fold, at least about 3.5-fold, at least about 4-fold, at least about 5-fold, or at least about 10-fold, compared to the amount of target protein produced by an control compound. A control compound can be, for example, an oligonucleotide that is not complementary to the targeted portion of the RIC pre-mRNA.

In some embodiments, contacting cells with an ASO that is complementary to a targeted portion of a SYNGAP1 or SCN1A RIC pre-mRNA transcript results in an increase in the amount of mRNA encoding SYNGAP1 or SCN1A, including the mature mRNA encoding the target protein. In some embodiments, the amount of mRNA encoding SYNGAP1 or SCN1A protein, or the mature mRNA encoding the SYNGAP1 or SCN1A protein, is increased by at least 10, 20, 30, 40, 50, 60, 80, 100, 150, 200, 250, 300, 350, 400, 450, 500, or 1000%, compared to the amount of the protein produced by a cell in the absence of the ASO/absence of treatment. In embodiments, the total amount of the mRNA encoding SYNGAP1 or SCN1A protein, or the mature mRNA encoding SYNGAP1 or SCN1A protein produced in the cell to which the antisense oligomer was contacted is increased about 1.1 to about 10-fold, about 1.5 to about 10-fold, about 2 to about 10-fold, about 3 to about 10-fold, about 4 to about 10-fold, about 1.1 to about 5-fold, about 1.1 to about 6-fold, about 1.1 to about 7-fold, about 1.1 to about 8-fold, about 1.1 to about 9-fold, about 2 to about 5-fold, about 2 to about 6-fold, about 2 to about 7-fold, about 2 to about 8-fold, about 2 to about 9-fold, about 3 to about 6-fold, about 3 to about 7-fold, about 3 to about 8-fold, about 3 to about 9-fold, about 4 to about 7-fold, about 4 to about 8-fold, about 4 to about 9-fold, at least about 1.1-fold, at least about 1.5-fold, at least about 2-fold, at least about 2.5-fold, at least about 3-fold, at least about 3.5-fold, at least about 4-fold, at least about 5-fold, or at least about 10-fold compared to the amount of mature RNA produced in an untreated cell, e.g., an untreated cell or a cell treated with a control compound. A control compound can be, for example, an oligonucleotide that is not complementary to the targeted portion of the SYNGAP1 or SCN1A RIC pre-mRNA.

Constitutive Splicing of a Retained Intron from a RIC Pre-mRNA

The methods and antisense oligonucleotide compositions provided herein are useful for increasing the expression of SYNGAP1 or SCN1A protein in cells, for example, in a subject having AD mental retardation 5 or Dravet syndrome caused by a deficiency in the amount or activity of SYNGAP1 or SCN1A protein, by increasing the level of mRNA encoding SYNGAP1 or SCN1A protein, or the mature mRNA encoding SYNGAP1 or SCN1A protein. In particular, the methods and compositions as described herein induce the constitutive splicing of a retained intron from a SYNGAP1 or SCN1A RIC pre-mRNA transcript encoding SYNGAP1 or SCN1A protein, thereby increasing the level of mRNA encoding SYNGAP1 or SCN1A protein, or the mature mRNA encoding SYNGAP1 or SCN1A protein and increasing the expression of SYNGAP1 or SCN1A protein.

Constitutive splicing of a retained intron from a RIC pre-mRNA correctly removes the retained intron from the RIC pre-mRNA, wherein the retained intron has wild-type splice sequences. Constitutive splicing, as used herein, does not encompass splicing of a retained intron from a RIC pre-mRNA transcribed from a gene or allele having a mutation that causes alternative splicing or aberrant splicing of a pre-mRNA transcribed from the gene or allele. For example, constitutive splicing of a retained intron, as induced using the methods and antisense oligonucleotides provided herein, does not correct aberrant splicing in or influence alternative splicing of a pre-mRNA to result in an increased expression of a target protein or functional RNA.

In embodiments, constitutive splicing correctly removes a retained intron from a SYNGAP1 or SCN1A RIC pre-mRNA, wherein the SYNGAP1 or SCN1A RIC pre-mRNA is transcribed from a wild-type gene or allele, or a polymorphic gene or allele, that encodes a fully-functional target protein or functional RNA, and wherein the gene or allele does not have a mutation that causes alternative splicing or aberrant splicing of the retained intron.

In some embodiments, constitutive splicing of a retained intron from a SYNGAP1 or SCN1A RIC pre-mRNA encoding SYNGAP1 or SCN1A protein correctly removes a retained intron from a SYNGAP1 or SCN1A RIC pre-mRNA encoding SYNGAP1 or SCN1A protein, wherein the SYNGAP1 or SCN1A RIC pre-mRNA is transcribed from a gene or allele from which the target gene or functional RNA is produced at a reduced level compared to production from a wild-type allele, and wherein the gene or allele does not have a mutation that causes alternative splicing or aberrant splicing of the retained intron.

In these embodiments, the correct removal of the constitutively spliced retained intron results in production of target protein or functional RNA that is functional when compared to an equivalent wild-type protein or functional RNA.

In other embodiments, constitutive splicing correctly removes a retained intron from a SYNGAP1 or SCN1A RIC pre-mRNA, wherein the SYNGAP1 or SCN1A RIC pre-mRNA is transcribed from a gene or allele that encodes a target protein or functional RNA produced in a form having reduced function compared to an equivalent wild-type protein or functional RNA, and wherein the gene or allele does not have a mutation that causes alternative splicing or aberrant splicing of the retained intron. In these embodiments, the correct removal of the constitutively spliced retained intron results in production of partially functional target protein, or functional RNA that is partially functional when compared to an equivalent wild-type protein or functional RNA.

"Correct removal" of the retained intron by constitutive splicing refers to removal of the entire intron, without removal of any part of an exon.

In embodiments, an antisense oligomer as described herein or used in any method described herein does not increase the amount of mRNA encoding SYNGAP1 or SCN1A protein or the amount of SYNGAP1 or SCN1A protein by modulating alternative splicing or aberrant splicing of a pre-mRNA transcribed from SCN1A or SYNGAP1. Modulation of alternative splicing or aberrant splicing can be measured using any known method for analyzing the sequence and length of RNA species, e.g., by RT-PCR and using methods described elsewhere herein and in the literature. In embodiments, modulation of alternative or aberrant splicing is determined based on an increase or decrease in the amount of the spliced species of interest of at least 10% or 1.1-fold. In embodiments, modulation is determined based on an increase or decrease at a level that is at least 10% to 100% or 1.1 to 10-fold, as described herein regarding determining an increase in mRNA encoding SYNGAP1 or SCN1A protein in the methods of the invention.

In embodiments, the method is a method wherein the SYNGAP1 or SCN1A RIC pre-mRNA was produced by partial splicing of a wild-type SYNGAP1 or SCN1A pre-mRNA. In embodiments, the method is a method wherein the SYNGAP1 or SCN1A RIC pre-mRNA was produced by partial splicing of a full-length wild-type SYNGAP1 or SCN1A pre-mRNA. In embodiments, the SYNGAP1 or SCN1A RIC pre-mRNA was produced by partial splicing of a full-length SYNGAP1 or SCN1A pre-mRNA. In these embodiments, a full-length SYNGAP1 or SCN1A pre-mRNA may have a polymorphism in a splice site of the retained intron that does not impair correct splicing of the retained intron as compared to splicing of the retained intron having the wild-type splice site sequence.

In embodiments, the mRNA encoding SYNGAP1 or SCN1A protein is a full-length mature mRNA, or a wild-type mature mRNA. In these embodiments, a full-length mature mRNA may have a polymorphism that does not affect the activity of the target protein or the functional RNA encoded by the mature mRNA, as compared to the activity of SYNGAP1 or SCN1A protein encoded by the wild-type mature mRNA.

Antisense Oligomers

One aspect of the present disclosure is a composition comprising antisense oligomers that enhances splicing by binding to a targeted portion of a SYNGAP1 or SCN1A RIC pre-mRNA. As used herein, the terms "ASO" and "antisense oligomer" are used interchangeably and refer to an oligomer such as a polynucleotide, comprising nucleobases that hybridizes to a target nucleic acid (e.g., a SYNGAP1 or SCN1A RIC pre-mRNA) sequence by Watson-Crick base pairing or wobble base pairing (G-U). The ASO may have exact sequence complementary to the target sequence or near complementarity (e.g., sufficient complementarity to bind the target sequence and enhancing splicing at a splice site). ASOs are designed so that they bind (hybridize) to a target nucleic acid (e.g., a targeted portion of a pre-mRNA transcript) and remain hybridized under physiological conditions. Typically, if they hybridize to a site other than the intended (targeted) nucleic acid sequence, they hybridize to a limited number of sequences that are not a target nucleic acid (to a few sites other than a target nucleic acid). Design of an ASO can take into consideration the occurrence of the nucleic acid sequence of the targeted portion of the pre-mRNA transcript or a sufficiently similar nucleic acid sequence in other locations in the genome or cellular pre-mRNA or transcriptome, such that the likelihood the ASO will bind other sites and cause "off-target" effects is limited. Any antisense oligomers known in the art, for example in PCT Application No. PCT/US2014/054151, published as WO 2015/035091, titled "Reducing Nonsense-Mediated mRNA Decay," incorporated by reference herein, can be used to practice the methods described herein.

In some embodiments, ASOs "specifically hybridize" to or are "specific" to a target nucleic acid or a targeted portion of a RIC pre-mRNA. Typically such hybridization occurs with a Tm substantially greater than 37° C., preferably at least 50° C., and typically between 60° C. to approximately 90° C. Such hybridization preferably corresponds to stringent hybridization conditions. At a given ionic strength and pH, the Tm is the temperature at which 50% of a target sequence hybridizes to a complementary oligonucleotide.

Oligomers, such as oligonucleotides, are "complementary" to one another when hybridization occurs in an antiparallel configuration between two single-stranded polynucleotides. A double-stranded polynucleotide can be "complementary" to another polynucleotide, if hybridization can occur between one of the strands of the first polynucleotide and the second. Complementarity (the degree to which one polynucleotide is complementary with another) is quantifiable in terms of the proportion (e.g., the percentage) of bases in opposing strands that are expected to form hydrogen bonds with each other, according to generally accepted base-pairing rules. The sequence of an antisense oligomer (ASO) need not be 100% complementary to that of its target nucleic acid to hybridize. In certain embodiments, ASOs can comprise at least 70%, at least 75%, at least 80%, at least 85%, at least 90%, at least 95%, at least 96%, at least 97%, at least 98%, or at least 99% sequence complementarity to a target region within the target nucleic acid sequence to which they are targeted. For example, an ASO in which 18 of 20 nucleobases of the oligomeric compound are complementary to a target region, and would therefore specifically hybridize, would represent 90 percent complementarity. In this example, the remaining non-complementary nucleobases may be clustered together or interspersed with complementary nucleobases and need not be contiguous to each other or to complementary nucleobases. Percent complementarity of an ASO with a region of a target nucleic acid can be determined routinely using BLAST programs (basic local alignment search tools) and PowerBLAST programs known in the art (Altschul, et al., J. Mol. Biol., 1990, 215, 403-410; Zhang and Madden, Genome Res., 1997, 7, 649-656).

An ASO need not hybridize to all nucleobases in a target sequence and the nucleobases to which it does hybridize may be contiguous or noncontiguous. ASOs may hybridize over one or more segments of a pre-mRNA transcript, such that intervening or adjacent segments are not involved in the hybridization event (e.g., a loop structure or hairpin structure may be formed). In certain embodiments, an ASO hybridizes to noncontiguous nucleobases in a target pre-mRNA transcript. For example, an ASO can hybridize to nucleobases in a pre-mRNA transcript that are separated by one or more nucleobase(s) to which the ASO does not hybridize.

The ASOs described herein comprise nucleobases that are complementary to nucleobases present in a target portion of a RIC pre-mRNA. The term ASO embodies oligonucleotides and any other oligomeric molecule that comprises nucleobases capable of hybridizing to a complementary nucleobase on a target mRNA but does not comprise a sugar moiety, such as a peptide nucleic acid (PNA). The ASOs may comprise naturally-occurring nucleotides, nucleotide analogs, modified nucleotides, or any combination of two or three of the preceding. The term "naturally occurring nucleotides" includes deoxyribonucleotides and ribonucleotides. The term "modified nucleotides" includes nucleotides with modified or substituted sugar groups and/or having a modified backbone. In some embodiments, all of the nucleotides of the ASO are modified nucleotides. Chemical modifications of ASOs or components of ASOs that are compatible with the methods and compositions described herein will be evident to one of skill in the art and can be found, for example, in U.S. Pat. No. 8,258,109 B2, U.S. Pat. No. 5,656,612, U.S. Patent Publication No. 2012/0190728, and Dias and Stein, Mol. Cancer Ther. 2002, 347-355, herein incorporated by reference in their entirety.

The nucleobase of an ASO may be any naturally occurring, unmodified nucleobase such as adenine, guanine, cytosine, thymine and uracil, or any synthetic or modified nucleobase that is sufficiently similar to an unmodified nucleobase such that it is capable of hydrogen bonding with a nucleobase present on a target pre-mRNA. Examples of modified nucleobases include, without limitation, hypoxanthine, xanthine, 7-methylguanine, 5, 6-dihydrouracil, 5-methylcytosine, and 5-hydroxymethoylcytosine.

The ASOs described herein also comprise a backbone structure that connects the components of an oligomer. The term "backbone structure" and "oligomer linkages" may be used interchangeably and refer to the connection between monomers of the ASO. In naturally occurring oligonucleotides, the backbone comprises a 3'-5' phosphodiester linkage connecting sugar moieties of the oligomer. The backbone structure or oligomer linkages of the ASOs described herein may include (but are not limited to) phosphorothioate, phosphorodithioate, phosphoroselenoate, phosphorodiselenoate, phosphoroanilothioate, phosphoraniladate, phosphoramidate, and the like. See, e.g., LaPlanche, et al., Nucleic Acids Res. 14:9081 (1986); Stec, et al., J. Am. Chem. Soc. 106:6077 (1984), Stein, et al., Nucleic Acids Res. 16:3209 (1988), Zon, et al., Anti Cancer Drug Design 6:539 (1991); Zon, et al., Oligonucleotides and Analogues: A Practical Approach, pp. 87-108 (F. Eckstein, Ed., Oxford University Press, Oxford England (1991)); Stec, et al., U.S. Pat. No. 5,151,510; Uhlmann and Peyman, Chemical Reviews 90:543 (1990). In some embodiments, the backbone structure of the ASO does not contain phosphorous but rather contains peptide bonds, for example in a peptide nucleic acid (PNA), or linking groups including carbamate, amides, and linear and cyclic hydrocarbon groups. In some embodiments, the backbone modification is a phosphothioate linkage. In some embodiments, the backbone modification is a phosphoramidate linkage.

In embodiments, the stereochemistry at each of the phosphorus internucleotide linkages of the ASO backbone is random. In embodiments, the stereochemistry at each of the phosphorus internucleotide linkages of the ASO backbone is controlled and is not random. For example, U.S. Pat. App. Pub. No. 2014/0194610, "Methods for the Synthesis of Functionalized Nucleic Acids," incorporated herein by reference, describes methods for independently selecting the handedness of chirality at each phosphorous atom in a nucleic acid oligomer. In embodiments, an ASO used in the methods of the invention, including, but not limited to, any of the ASOs set forth herein in Table 1, comprises an ASO having phosphorus internucleotide linkages that are not random. In embodiments, a composition used in the methods of the invention comprises a pure diastereomeric ASO. In embodiments, a composition used in the methods of the invention comprises an ASO that has diastereomeric purity of at least about 90%, at least about 91%, at least about 92%, at least about 93%, at least about 94%, at least about 95%, at least about 96%, at least about 97%, at least about 98%, at least about 99%, about 100%, about 90% to about 100%, about 91% to about 100%, about 92% to about 100%, about 93% to about 100%, about 94% to about 100%, about 95% to about 100%, about 96% to about 100%, about 97% to about 100%, about 98% to about 100%, or about 99% to about 100%.

In embodiments, the ASO has a nonrandom mixture of Rp and Sp configurations at its phosphorus internucleotide linkages. For example, it has been suggested that a mix of Rp and Sp is required in antisense oligonucleotides to achieve a balance between good activity and nuclease stability (Wan, et al., 2014, "Synthesis, biophysical properties and biological activity of second generation antisense oligonucleotides containing chiral phosphorothioate linkages," Nucleic Acids Research 42(22): 13456-13468, incorporated herein by reference). In embodiments, an ASO used in the methods of the invention, including, but not limited to, any of the ASOs set forth herein in Table 1, comprises about 5-100% Rp, at least about 5% Rp, at least about 10% Rp, at least about 15% Rp, at least about 20% Rp, at least about 25% Rp, at least about 30% Rp, at least about 35% Rp, at least about 40% Rp, at least about 45% Rp, at least about 50% Rp, at least about 55% Rp, at least about 60% Rp, at least about 65% Rp, at least about 70% Rp, at least about 75% Rp, at least about 80% Rp, at least about 85% Rp, at least about 90% Rp, or at least about 95% Rp, with the remainder Sp, or about 100% Rp. In embodiments, an ASO used in the methods of the invention, including, but not limited to, any of the ASOs set forth herein in Table 1, comprises about 10% to about 100% Rp, about 15% to about 100% Rp, about 20% to about 100% Rp, about 25% to about 100% Rp, about 30% to about 100% Rp, about 35% to about 100% Rp, about 40% to about 100% Rp, about 45% to about 100% Rp, about 50% to about 100% Rp, about 55% to about 100% Rp, about 60% to about 100% Rp, about 65% to about 100% Rp, about 70% to about 100% Rp, about 75% to about 100% Rp, about 80% to about 100% Rp, about 85% to about 100% Rp, about 90% to about 100% Rp, or about 95% to about 100% Rp, about 20% to about 80% Rp, about 25% to about 75% Rp, about 30% to about 70% Rp, about 40% to about 60% Rp, or about 45% to about 55% Rp, with the remainder Sp.

In embodiments, an ASO used in the methods of the invention, including, but not limited to, any of the ASOs set forth herein in Table 1, comprises about 5-100% Sp, at least about 5% Sp, at least about 10% Sp, at least about 15% Sp, at least about 20% Sp, at least about 25% Sp, at least about 30% Sp, at least about 35% Sp, at least about 40% Sp, at least about 45% Sp, at least about 50% Sp, at least about 55% Sp, at least about 60% Sp, at least about 65% Sp, at least about 70% Sp, at least about 75% Sp, at least about 80% Sp, at least about 85% Sp, at least about 90% Sp, or at least about 95% Sp, with the remainder Rp, or about 100% Sp. In embodiments, an ASO used in the methods of the invention, including, but not limited to, any of the ASOs set forth herein in Table 1, comprises about 10% to about 100% Sp, about 15% to about 100% Sp, about 20% to about 100% Sp, about 25% to about 100% Sp, about 30% to about 100% Sp, about 35% to about 100% Sp, about 40% to about 100% Sp, about 45% to about 100% Sp, about 50% to about 100% Sp, about 55% to about 100% Sp, about 60% to about 100% Sp, about 65% to about 100% Sp, about 70% to about 100% Sp, about 75% to about 100% Sp, about 80% to about 100% Sp, about 85% to about 100% Sp, about 90% to about 100% Sp, or about 95% to about 100% Sp, about 20% to about 80% Sp, about 25% to about 75% Sp, about 30% to about 70% Sp, about 40% to about 60% Sp, or about 45% to about 55% Sp, with the remainder Rp.

Any of the ASOs described herein may contain a sugar moiety that comprises ribose or deoxyribose, as present in naturally occurring nucleotides, or a modified sugar moiety or sugar analog, including a morpholine ring. Non-limiting examples of modified sugar moieties include 2' substitutions such as 2'-O-methyl (2'-O-Me), 2'-O-methoxyethyl (2'MOE), 2'-O-aminoethyl, 2'F; N3'→P5' phosphoramidate, 2'dimethylaminooxyethoxy, 2'dimethylaminoethoxyethoxy, 2'-guanidinidium, 2'-O-guanidinium ethyl, carbamate modified sugars, and bicyclic modified sugars. In some embodiments, the sugar moiety modification is selected from 2'-O-Me, 2'F, and 2'MOE. In some embodiments, the sugar moiety modification is an extra bridge bond, such as in a locked nucleic acid (LNA). In some embodiments the sugar analog contains a morpholine ring, such as phosphorodiamidate morpholino (PMO). In some embodiments, the sugar moiety comprises a ribofuransyl or 2'deoxyribofuransyl modification. In some embodiments, the sugar moiety comprises 2'4'-constrained 2'O-methyloxyethyl (cMOE) modifications. In some embodiments, the sugar moiety comprises cEt 2',4' constrained 2'-O ethyl BNA modifications. In some embodiments, the sugar moiety comprises tricycloDNA (tcDNA) modifications. In some embodiments, the sugar moiety comprises ethylene nucleic acid (ENA) modifications. In some embodiments, the sugar moiety comprises MCE modifications. Modifications are known in the art and described in the literature, e.g., by Jarver, et al., 2014, "A Chemical View of Oligonucleotides for Exon Skipping and Related Drug Applications," Nucleic Acid Therapeutics 24(1): 37-47, incorporated by reference for this purpose herein.

In some examples, each monomer of the ASO is modified in the same way, for example each linkage of the backbone of the ASO comprises a phosphorothioate linkage or each ribose sugar moiety comprises a 2'O-methyl modification. Such modifications that are present on each of the monomer components of an ASO are referred to as "uniform modifications." In some examples, a combination of different modifications may be desired, for example, an ASO may comprise a combination of phosphorodiamidate linkages and sugar moieties comprising morpholine rings (morpholinos). Combinations of different modifications to an ASO are referred to as "mixed modifications" or "mixed chemistries."

In some embodiments, the ASO comprises one or more backbone modification. In some embodiments, the ASO comprises one or more sugar moiety modification. In some embodiments, the ASO comprises one or more backbone modification and one or more sugar moiety modification. In some embodiments, the ASO comprises 2'MOE modifications and a phosphorothioate backbone. In some embodiments, the ASO comprises a phosphorodiamidate morpholino (PMO). In some embodiments, the ASO comprises a peptide nucleic acid (PNA). Any of the ASOs or any component of an ASO (e.g., a nucleobase, sugar moiety, backbone) described herein may be modified in order to achieve desired properties or activities of the ASO or reduce undesired properties or activities of the ASO. For example, an ASO or one or more component of any ASO may be modified to enhance binding affinity to a target sequence on a pre-mRNA transcript; reduce binding to any non-target sequence; reduce degradation by cellular nucleases (i.e., RNase H); improve uptake of the ASO into a cell and/or into the nucleus of a cell; alter the pharmacokinetics or pharmacodynamics of the ASO; and modulate the half-life of the ASO.

In some embodiments, the ASOs are comprised of 2'-O-(2-methoxyethyl) (MOE) phosphorothioate-modified nucleotides. ASOs comprised of such nucleotides are especially well-suited to the methods disclosed herein; oligomers having such modifications have been shown to have significantly enhanced resistance to nuclease degradation and increased bioavailability, making them suitable, for example, for oral delivery in some embodiments described herein. See e.g., Geary, et al., J Pharmacol Exp Ther. 2001; 296(3):890-7; Geary, et al., J Pharmacol Exp Ther. 2001; 296(3):898-904.

Methods of synthesizing ASOs will be known to one of skill in the art. Alternatively or in addition, ASOs may be obtained from a commercial source.

Unless specified otherwise, the left-hand end of single-stranded nucleic acid (e.g., pre-mRNA transcript, oligonucleotide, ASO, etc.) sequences is the 5' end and the left-hand direction of single or double-stranded nucleic acid sequences is referred to as the 5' direction. Similarly, the right-hand end or direction of a nucleic acid sequence (single or double stranded) is the 3' end or direction. Generally, a region or sequence that is 5' to a reference point in a nucleic acid is referred to as "upstream," and a region or sequence that is 3' to a reference point in a nucleic acid is referred to as "downstream." Generally, the 5' direction or end of an mRNA is where the initiation or start codon is located, while the 3' end or direction is where the termination codon is located. In some aspects, nucleotides that are upstream of a reference point in a nucleic acid may be designated by a negative number, while nucleotides that are downstream of a reference point may be designated by a positive number. For example, a reference point (e.g., an exon-exon junction in mRNA) may be designated as the "zero" site, and a nucleotide that is directly adjacent and upstream of the reference point is designated "minus one," e.g., "−1," while a nucleotide that is directly adjacent and downstream of the reference point is designated "plus one," e.g., "+1."

In some embodiments, the ASOs are complementary to (and bind to) a targeted portion of a SCN1A RIC pre-mRNA that is downstream (in the 3' direction) of the 5' splice site of the retained intron in a SCN1A RIC pre-mRNA (e.g., the direction designated by positive numbers relative to the 5' splice site) (FIG. 1). In some embodiments, the ASOs are complementary to a targeted portion of the SCN1A RIC pre-mRNA that is within the region about +6 to about +500 relative to the 5' splice site of the retained intron. In some embodiments, the ASO is not complementary to nucleotides +1 to +5 relative to the 5' splice site (the first five nucleotides located downstream of the 5' splice site). In some embodiments, the ASOs may be complementary to a targeted portion of a SCN1A RIC pre-mRNA that is within the region between nucleotides +6 and +496 relative to the 5' splice site of the retained intron. In some aspects, the ASOs are complementary to a targeted portion that is within the region about +6 to about +500, about +6 to about +490, about +6 to about +480, about +6 to about +470, about +6 to about +460, about +6 to about +450, about +6 to about +440, about +6 to about +430, about +6 to about +420, about +6 to about +410, about +6 to about +400, about +6 to about +390, about +6 to about +380, about +6 to about +370, about +6 to about +360, about +6 to about +350, about +6 to about +340, about +6 to about +330, about +6 to about +320, about +6 to about +310, about +6 to about +300, about +6 to about +290, about +6 to about +280, about +6 to about +270, about +6 to about +260, about +6 to about +250, about +6 to about +240, about +6 to about +230, about +6 to about +220, about +6 to about +210, about +6 to about +200, about +6 to about +190, about +6 to about +180, about +6 to about +170, about +6 to about +160, about +6 to about +150, about +6 to about +140, about +6 to about +130, about +6 to about +120, about +6 to about +110, about +6 to about +100, about +6 to about +90, about +6 to about +80, about +6 to about +70, about +6 to about +60, about +6 to about +50, about +6 to about +40, about +6 to about +30, or about +6 to about +20 relative to 5' splice site of the retained intron.

In some embodiments, the ASOs are complementary to (and bind to) a targeted portion of a SCN1A RIC pre-mRNA that is upstream (in the 5' direction) of the 5' splice site of the retained intron in a SCN1A RIC pre-mRNA (e.g., the direction designated by negative numbers relative to the 5' splice site) (FIG. 1). In some embodiments, the ASOs are complementary to a targeted portion of the SCN1A RIC pre-mRNA that is within the region about −4e to about −270e relative to the 5' splice site of the retained intron. In some embodiments, the ASO is not complementary to nucleotides −1e to −3e relative to the 5' splice site (the first three nucleotides located upstream of the 5' splice site). In some embodiments, the ASOs may be complementary to a targeted portion of a SCN1A RIC pre-mRNA that is within the region between nucleotides −4e and −264e relative to the 5' splice site of the retained intron. In some aspects, the ASOs are complementary to a targeted portion that is within the region about −4e to about −270e, about −4e to about −260e, about −4e to about −250e, about −4e to about −240e, about −4e to about −230e, about −4e to about −220e, about −4e to about −210e, about −4e to about −200e, about −4e to about −190e, about −4e to about −180e, about −4e to about −170e, about −4e to about −160e, about −4e to about −150e, about −4e to about −140e, about −4e to about −130e, about −4e to about −120e, about −4e to about −110e, about −4e to about −100e, about −4e to about −90e, about −4e to about −80e, about −4e to about −70e, about −4e to about −60e, about −4e to about −50e, about −4e to about −40e, about −4e to about −30e, or about −4e to about −20e relative to 5' splice site of the retained intron.

In some embodiments, the ASOs are complementary to a targeted region of a SCN1A RIC pre-mRNA that is upstream (in the 5' direction) of the 3' splice site of the retained intron in a SCN1A RIC pre-mRNA (e.g., in the direction designated by negative numbers) (FIG. 1). In some embodiments, the ASOs are complementary to a targeted portion of the SCN1A RIC pre-mRNA that is within the region about −16 to about −500 relative to the 3' splice site of the retained intron. In some embodiments, the ASO is not complementary to nucleotides −1 to −15 relative to the 3' splice site (the first 15 nucleotides located upstream of the 3' splice site). In some embodiments, the ASOs are complementary to a targeted portion of the SCN1A RIC pre-mRNA that is within the region −16 to −496 relative to the 3' splice site of the retained intron. In some aspects, the ASOs are complementary to a targeted portion that is within the region about −16 to about −500, about −16 to about −490, about −16 to about −480, about −16 to about −470, about −16 to about −460, about −16 to about −450, about −16 to about −440, about −16 to about −430, about −16 to about −420, about −16 to about −410, about −16 to about −400, about −16 to about −390, about −16 to about −380, about −16 to about −370, about −16 to about −360, about −16 to about −350, about −16 to about −340, about −16 to about −330, about −16 to about −320, about −16 to about −310, about −16 to about −300, about −16 to about −290, about −16 to about −280, about −16 to about −270, about −16 to about −260, about −16 to about −250, about −16 to about −240, about −16 to about −230, about −16 to about −220, about −16 to about −210, about −16 to about −200, about −16 to about −190, about −16 to about −180, about −16 to about −170, about −16 to about −160, about −16 to about −150, about −16 to about −140, about −16 to about −130, about −16 to about −120, about −16 to about −110, about −16 to about −100, about −16 to about −90, about −16 to about −80, about −16 to about −70, about −16 to about −60, about −16 to about −50, about −16 to about −40, or about −16 to about −30 relative to 3' splice site of the retained intron.

In some embodiments, the ASOs are complementary to a targeted region of a SCN1A RIC pre-mRNA that is downstream (in the 3' direction) of the 3' splice site of the retained intron in a SCN1A RIC pre-mRNA (e.g., in the direction designated by positive numbers) (FIG. 1). In some embodiments, the ASOs are complementary to a targeted portion of the SCN1A RIC pre-mRNA that is within the region about +2e to about +40e relative to the 3' splice site of the retained intron. In some embodiments, the ASO is not complementary to nucleotides +1e relative to the 3' splice site (the first nucleotide located downstream of the 3' splice site). In some embodiments, the ASOs may be complementary to a targeted portion of a SCN1A RIC pre-mRNA that is within the region between nucleotides +2e and +37e relative to the 3' splice site of the retained intron. In some aspects, the ASOs are complementary to a targeted portion that is within the region about +2e to about +40e, about +2e to about +30e, about +2e to about +20e, or about +2e to about +10e relative to 3' splice site of the retained intron.

In some embodiments, the ASOs are complementary to (and bind to) a targeted portion of a SYNGAP1 RIC pre-mRNA that is downstream (in the 3' direction) of the 5' splice site of the retained intron in a SYNGAP1 RIC pre-mRNA (e.g., the direction designated by positive numbers relative to the 5' splice site) (FIG. 1). In some embodiments, the ASOs are complementary to a targeted portion of the SYNGAP1 RIC pre-mRNA that is within the region about +6 to about +500 relative to the 5' splice site of the retained intron. In some embodiments, the ASO is not complementary to nucleotides +1 to +5 relative to the 5' splice site (the first five nucleotides located downstream of the 5' splice site). In some embodiments, the ASOs may be complementary to a targeted portion of a SYNGAP1 RIC pre-mRNA that is within the region between nucleotides +6 and +496 relative to the 5' splice site of the retained intron. In some embodiments, the ASOs may be complementary to a targeted portion of a SYNGAP1 RIC pre-mRNA that is within the region between nucleotides +6 and +251 relative to the 5' splice site of the retained intron. In some aspects, the ASOs are complementary to a targeted portion that is within the region about +6 to about +500, about +6 to about +490, about +6 to about +480, about +6 to about +470, about +6 to about +460, about +6 to about +450, about +6 to about +440, about +6 to about +430, about +6 to about +420, about +6 to about +410, about +6 to about +400, about +6 to about +390, about +6 to about +380, about +6 to about +370, about +6 to about +360, about +6 to about +350, about +6 to about +340, about +6 to about +330, about +6 to about +320, about +6 to about +310, about +6 to about +300, about +6 to about +290, about +6 to about +280, about +6 to about +270, about +6 to about +260, about +6 to about +250, about +6 to about +240, about +6 to about +230, about +6 to about +220, about +6 to about +210, about +6 to about +200, about +6 to about +190, about +6 to about +180, about +6 to about +170, about +6 to about +160, about +6 to about +150, about +6 to about +140, about +6 to about +130, about +6 to about +120, about +6 to about +110, about +6 to about +100, about +6 to about +90, about +6 to about +80, about +6 to about +70, about +6 to about +60, about +6 to about +50, about +6 to about +40, about +6 to about +30, or about +6 to about +20 relative to 5' splice site of the retained intron.

In some embodiments, the ASOs are complementary to (and bind to) a targeted portion of a SYNGAP1 RIC pre-mRNA that is upstream (in the 5' direction) of the 5' splice site of the retained intron in a SYNGAP1 RIC pre-mRNA (e.g., the direction designated by negative numbers relative to the 5' splice site) (FIG. 1). In some embodiments, the ASOs are complementary to a targeted portion of the SYNGAP1 RIC pre-mRNA that is within the region about −4e to about −1,060e relative to the 5' splice site of the retained intron. In some embodiments, the ASO is not complementary to nucleotides −1e to −3e relative to the 5' splice site (the first three nucleotides located upstream of the 5' splice site). In some embodiments, the ASOs may be complementary to a targeted portion of a SYNGAP1 RIC pre-mRNA that is within the region between nucleotides −4e and −1054e relative to the 5' splice site of the retained intron. In some embodiments, the ASOs may be complementary to a targeted portion of a SYNGAP1 RIC pre-mRNA that is within the region between nucleotides −4e and −73e relative to the 5' splice site of the retained intron. In some aspects, the ASOs are complementary to a targeted portion that is within the region about −4e to about −1,060e, about −4e to about −1,050e, about −4e to about −1,040e, about −4e to about −1,030e, about −4e to about −1,020e, about −4e to about −1,010e, about −4e to about −1,000e, about −4e to about −990e, about −4e to about −980e, about −4e to about −970e, about −4e to about −960e, about −4e to about −950e, about −4e to about −940e, about −4e to about −930e, about −4e to about −920e, about −4e to about −910e, about −4e to about −900e, about −4e to about −890e, about −4e to about −880e, about −4e to about −870e, about −4e to about −860e, about −4e to about −850e, about −4e to about −840e, about −4e to about −830e, about −4e to about −820e, about −4e to about −810e, about −4e to about −800e, about −4e to about −790e, about −4e to about −780e, about −4e to about −770e, about −4e to about −760e, about −4e to about −750e, about −4e to about −740e, about −4e to about −730e, about −4e to about −720e, about −4e to about −710e, about −4e to about −700e, about −4e to about −690e, about −4e to about −680e, about −4e to about −670e, about −4e to about −660e, about −4e to about −650e, about −4e to about −640e, about −4e to about −630e, about −4e to about −620e, about −4e to about −610e, about −4e to about −600e, about −4e to about −590e, about −4e to about −580e, about −4e to about −570e, about −4e to about −560e, about −4e to about −550e, about −4e to about −540e, about −4e to about −530e, about −4e to about −520e, about −4e to about −510e, about −4e to about −500e, about −4e to about −490e, about −4e to about −480e, about −4e to about −470e, about −4e to about −460e, about −4e to about −450e, about −4e to about −440e, about −4e to about −430e, about −4e to about −420e, about −4e to about −410e, about −4e to about −400e, about −4e to about −390e, about −4e to about −380e, about −4e to about −370e, about −4e to about −360e, about −4e to about −350e, about −4e to about −340e, about −4e to about −330e, about −4e to about −320e, about −4e to about −310e, about −4e to about −300e, about −4e to about −290e, about −4e to about −280e, about −4e to about −270e, about −4e to about −260e, about −4e to about −250e, about −4e to about −240e, about −4e to about −230e, about −4e to about −220e, about −4e to about −210e, about −4e to about −200e, about −4e to about −190e, about −4e to about −180e, about −4e to about −170e, about −4e to about −160e, about −4e to about −150e, about −4e to about −140e, about −4e to about −130e, about −4e to about −120e, about −4e to about −110e, about −4e to about −100e, about −4e to about −90e, about −4e to about −80e, about −4e to about −70e, about −4e to about −60e, about −4e to about −50e, about −4e to about −40e, about −4e to about −30e, or about −4e to about −20e relative to 5' splice site of the retained intron.

In some embodiments, the ASOs are complementary to a targeted region of a SYNGAP1 RIC pre-mRNA that is upstream (in the 5' direction) of the 3' splice site of the retained intron in a SYNGAP1 RIC pre-mRNA (e.g., in the direction designated by negative numbers) (FIG. 1). In some embodiments, the ASOs are complementary to a targeted portion of the SYNGAP1 RIC pre-mRNA that is within the region of about −16 to about −500 relative to the 3' splice site of the retained intron. In some embodiments, the ASO is not complementary to nucleotides −1 to −15 relative to the 3' splice site (the first 15 nucleotides located upstream of the 3' splice site). In some embodiments, the ASOs are complementary to a targeted portion of the SYNGAP1 RIC pre-mRNA that is within the region −16 to −256 relative to the 3' splice site of the retained intron. In some embodiments, the ASOs are complementary to a targeted portion of the SYNGAP1 RIC pre-mRNA that is within the region −16 to −496 relative to the 3' splice site of the retained intron. In some aspects, the ASOs are complementary to a targeted portion that is within the region about −16 to about −500, about −16 to about −490, about −16 to about −480, about −16 to about −470, about −16 to about −460, about −16 to about −450, about −16 to about −440, about −16 to about −430, about −16 to about −420, about −16 to about −410, about −16 to about −400, about −16 to about −390, about −16 to about −380, about −16 to about −370, about −16 to about −360, about −16 to about −350, about −16 to about −340, about −16 to about −330, about −16 to about −320, about −16 to about −310, about −16 to about −300, about −16 to about −290, about −16 to about −280, about −16 to about −270, about −16 to about −260, about −16 to about −250, about −16 to about −240, about −16 to about −230, about −16 to about −220, about −16 to about −210, about −16 to about −200, about −16 to about −190, about −16 to about −180, about −16 to about −170, about −16 to about −160, about −16 to about −150, about −16 to about −140, about −16 to about −130, about −16 to about −120, about −16 to about −110, about −16 to about −100, about −16 to about −90, about −16 to about −80, about −16 to about −70, about −16 to about −60, about −16 to about −50, about −16 to about −40, or about −16 to about −30 relative to 3' splice site of the retained intron.

In some embodiments, the ASOs are complementary to a targeted region of a SYNGAP1 RIC pre-mRNA that is downstream (in the 3' direction) of the 3' splice site of the retained intron in a SYNGAP1 RIC pre-mRNA (e.g., in the direction designated by positive numbers) (FIG. 1). In some embodiments, the ASOs are complementary to a targeted portion of the SYNGAP1 RIC pre-mRNA that is within the region of about +2e to about +1,920e relative to the 3' splice site of the retained intron. In some embodiments, the ASO is not complementary to nucleotides +1e relative to the 3' splice site (the first nucleotide located downstream of the 3' splice site). In some embodiments, the ASO is not complementary to nucleotides +16e relative to the 3' splice site (the first sixteen nucleotides located downstream of the 3' splice site). In some embodiments, the ASOs may be complementary to a targeted portion of a SYNGAP1 RIC pre-mRNA that is within the region between nucleotides +2e and +157e relative to the 3' splice site of the retained intron. In some embodiments, the ASOs may be complementary to a targeted portion of a SYNGAP1 RIC pre-mRNA that is within the region between nucleotides +2e and +1,912e relative to the 3' splice site of the retained intron. In some aspects, the ASOs are complementary to a targeted portion that is within the region about +2e to about +1,920e, about +2e to about +1,910e, about +2e to about +1,900e, about +2e to about +1,890e, about +2e to about +1,880e, about +2e to about +1,870e, about +2e to about +1,860e, about +2e to about +1,850e, about +2e to about +1,840e, about +2e to about +1,830e, about +2e to about +1,820e, about +2e to about +1,810e, about +2e to about +1,800e, about +2e to about +1,790e, about +2e to about +1,780e, about +2e to about +1,770e, about +2e to about +1,760e, about +2e to about +1,750e, about +2e to about +1,740e, about +2e to about +1,730e, about +2e to about +1,720e, about +2e to about +1,710e, about +2e to about +1,700e, about +2e to about +1,690e, about +2e to about +1,680e, about +2e to about +1,670e, about +2e to about +1,660e, about +2e to about +1,650e, about +2e to about +1,640e, about +2e to about +1,630e, about +2e to about +1,620e, about +2e to about +1,610e, about +2e to about +1,600e, about +2e to about +1,590e, about +2e to about +1,580e, about +2e to about +1,570e, about +2e to about +1,560e, about +2e to about +1,550e, about +2e to about +1,540e, about +2e to about +1,530e, about +2e to about +1,520e, about +2e to about +1,510e, about +2e to about +1,500e, about +2e to about +1,490e, about +2e to about +1,480e, about +2e to about +1,470e, about +2e to about +1,460e, about +2e to about +1,450e, about +2e to about +1,440e, about +2e to about +1,430e, about +2e to about +1,420e, about +2e to about +1,410e, about +2e to about +1,400e, about +2e to about +1,390e, about +2e to about +1,380e, about +2e to about +1,370e, about +2e to about +1,360e, about +2e to about +1,350e, about +2e to about +1,340e, about +2e to about +1,330e, about +2e to about +1,320e, about +2e to about +1,310e, about +2e to about +1,300e, about +2e to about +1,290e, about +2e to about +1,280e, about +2e to about +1,270e, about +2e to about +1,260e, about +2e to about +1,250e, about +2e to about +1,240e, about +2e to about +1,230e, about +2e to about +1,220e, about +2e to about +1,210e, about +2e to about +1,200e, about +2e to about +1,190e, about +2e to about +1,180e, about +2e to about +1,170e, about +2e to about +1,160e, about +2e to about +1,150e, about +2e to about +1,140e, about +2e to about +1,130e, about +2e to about +1,120e, about +2e to about +1,110e, about +2e to about +1,100e, about +2e to about +1,090e, about +2e to about +1,080e, about +2e to about +1,070e, about +2e to about +1,060e, about +2e to about +1,050e, about +2e to about +1,040e, about +2e to about +1,030e, about +2e to about +1,020e, about +2e to about +1,010e, about +2e to about +1,000e, about +2e to about +990e, about +2e to about +980e, about +2e to about +970e, about +2e to about +960e, about +2e to about +950e, about +2e to about +940e, about +2e to about +930e, about +2e to about +920e, about +2e to about +910e, about +2e to about +900e, about +2e to about +890e, about +2e to about +880e, about +2e to about +870e, about +2e to about +860e, about +2e to about +850e, about +2e to about +840e, about +2e to about +830e, about +2e to about +820e, about +2e to about +810e, about +2e to about +800e, about +2e to about +790e, about +2e to about +780e, about +2e to about +770e, about +2e to about +760e, about +2e to about +750e, about +2e to about +740e, about +2e to about +730e, about +2e to about +720e, about +2e to about +710e, about +2e to about +700e, about +2e to about +690e, about +2e to about +680e, about +2e to about +670e, about +2e to about +660e, about +2e to about +650e, about +2e to about +640e, about +2e to about +630e, about +2e to about +620e, about +2e to about +610e, about +2e to about +600e, about +2e to about +590e, about +2e to about +580e, about +2e to about +570e, about +2e to about +560e, about +2e to about +550e, about +2e to about +540e, about +2e to about +530e, about +2e to about +520e, about +2e to about +510e, about +2e to about +500e, about +2e to about +490e, about +2e to about +480e, about +2e to about +470e, about +2e to about +460e, about +2e to about +450e, about +2e to about +440e, about +2e to about +430e, about +2e to about +420e, about +2e to about +410e, about +2e to about +400e, about +2e to about +390e, about +2e to about +380e, about +2e to about +370e, about +2e to about +360e, about +2e to about +350e, about +2e to about +340e, about +2e to about +330e, about +2e to about +320e, about +2e to about +310e, about +2e to about +300e, about +2e to about +290e, about +2e to about +280e, about +2e to about +270e, about +2e to about +260e, about +2e to about +250e, about +2e to about +240e, about +2e to about +230e, about +2e to about +220e, about +2e to about +210e, about +2e to about +200e, about +2e to about +190e, about +2e to about +180e, about +2e to about +170e, about +2e to about +160e, about +2e to about +150e, about +2e to about +140e, about +2e to about +130e, about +2e to about +120e, about +2e to about +110e, about +2e to about +100e, about +2e to about +90e, about +2e to about +80e, about +2e to about +70e, about +2e to about +60e, about +2e to about +50e, about +2e to about +40e, about +2e to about +30e, or about +2e to about +20e relative to 3' splice site of the retained intron.

In embodiments, the targeted portion of the SYNGAP1 or SCN1A RIC pre-mRNA is within the region +100 relative to the 5' splice site of the retained intron to −100 relative to the 3' splice site of the retained intron.

The ASOs may be of any length suitable for specific binding and effective enhancement of splicing. In some embodiments, the ASOs consist of 8 to 50 nucleobases. For example, the ASO may be 8, 9, 10, 11, 12, 13, 14, 15, 16, 17, 18, 19, 20, 21, 22, 23, 24, 25, 26, 27, 28, 29, 30, 31, 32, 33, 34, 35, 40, 45, or 50 nucleobases in length. In some embodiments, the ASOs consist of more than 50 nucleobases. In some embodiments, the ASO is from 8 to 50 nucleobases, 8 to 40 nucleobases, 8 to 35 nucleobases, 8 to 30 nucleobases, 8 to 25 nucleobases, 8 to 20 nucleobases, 8 to 15 nucleobases, 9 to 50 nucleobases, 9 to 40 nucleobases, 9 to 35 nucleobases, 9 to 30 nucleobases, 9 to 25 nucleobases, 9 to 20 nucleobases, 9 to 15 nucleobases, 10 to 50 nucleobases, 10 to 40 nucleobases, 10 to 35 nucleobases, 10 to 30 nucleobases, 10 to 25 nucleobases, 10 to 20 nucleobases, 10 to 15 nucleobases, 11 to 50 nucleobases, 11 to 40 nucleobases, 11 to 35 nucleobases, 11 to 30 nucleobases, 11 to 25 nucleobases, 11 to 20 nucleobases, 11 to 15 nucleobases, 12 to 50 nucleobases, 12 to 40 nucleobases, 12 to 35 nucleobases, 12 to 30 nucleobases, 12 to 25 nucleobases, 12 to 20 nucleobases, 12 to 15 nucleobases, 13 to 50 nucleobases, 13 to 40 nucleobases, 13 to 35 nucleobases, 13 to 30 nucleobases, 13 to 25 nucleobases, 13 to 20 nucleobases, 14 to 50 nucleobases, 14 to 40 nucleobases, 14 to 35 nucleobases, 14 to 30 nucleobases, 14 to 25 nucleobases, 14 to 20 nucleobases, 15 to 50 nucleobases, 15 to 40 nucleobases, 15 to 35 nucleobases, 15 to 30 nucleobases, 15 to 25 nucleobases, 15 to 20 nucleobases, 20 to 50 nucleobases, 20 to 40 nucleobases, 20 to 35 nucleobases, 20 to 30 nucleobases, 20 to 25 nucleobases, 25 to 50 nucleobases, 25 to 40 nucleobases, 25 to 35 nucleobases, or 25 to 30 nucleobases in length. In some embodiments, the ASOs are 18 nucleotides in length. In some embodiments, the ASOs are 15 nucleotides in length. In some embodiments, the ASOs are 25 nucleotides in length.

In some embodiments, two or more ASOs with different chemistries but complementary to the same targeted portion of the RIC pre-mRNA are used. In some embodiments, two or more ASOs that are complementary to different targeted portions of the RIC pre-mRNA are used.

In embodiments, the antisense oligonucleotides of the invention are chemically linked to one or more moieties or conjugates, e.g., a targeting moiety or other conjugate that enhances the activity or cellular uptake of the oligonucleotide. Such moieties include, but are not limited to, a lipid moiety, e.g., as a cholesterol moiety, a cholesteryl moiety, an aliphatic chain, e.g., dodecandiol or undecyl residues, a polyamine or a polyethylene glycol chain, or adamantane acetic acid. Oligonucleotides comprising lipophilic moieties and preparation methods have been described in the published literature. In embodiments, the antisense oligonucleotide is conjugated with a moiety including, but not limited to, an abasic nucleotide, a polyether, a polyamine, a polyamide, a peptides, a carbohydrate, e.g., N-acetylgalactosamine (GalNAc), N-Ac-Glucosamine (GluNAc), or mannose (e.g., mannose-6-phosphate), a lipid, or a polyhydrocarbon compound. Conjugates can be linked to one or more of any nucleotides comprising the antisense oligonucleotide at any of several positions on the sugar, base or phosphate group, as understood in the art and described in the literature, e.g., using a linker. Linkers can include a bivalent or trivalent branched linker. In embodiments, the conjugate is attached to the 3' end of the antisense oligonucleotide. Methods of preparing oligonucleotide conjugates are described, e.g., in U.S. Pat. No. 8,450,467, "Carbohydrate conjugates as delivery agents for oligonucleotides," incorporated by reference herein.

In some embodiments, the nucleic acid to be targeted by an ASO is a SYNGAP1 or SCN1A RIC pre-mRNA expressed in a cell, such as a eukaryotic cell. In some embodiments, the term "cell" may refer to a population of cells. In some embodiments, the cell is in a subject. In some embodiments, the cell is isolated from a subject. In some embodiments, the cell is ex vivo. In some embodiments, the cell is a condition or disease-relevant cell or a cell line. In some embodiments, the cell is in vitro (e.g., in cell culture).

Pharmaceutical Compositions

Pharmaceutical compositions or formulations comprising the antisense oligonucleotide of the described compositions and for use in any of the described methods can be prepared according to conventional techniques well known in the pharmaceutical industry and described in the published literature. In embodiments, a pharmaceutical composition or formulation for treating a subject comprises an effective amount of any antisense oligomer as described above, or a pharmaceutically acceptable salt, solvate, hydrate or ester thereof, and a pharmaceutically acceptable diluent. The antisense oligomer of a pharmaceutical formulation may further comprise a pharmaceutically acceptable excipient, diluent or carrier.

Pharmaceutically acceptable salts are suitable for use in contact with the tissues of humans and lower animals without undue toxicity, irritation, allergic response, etc., and are commensurate with a reasonable benefit/risk ratio. (See, e.g., S. M. Berge, et al., J. Pharmaceutical Sciences, 66: 1-19 (1977), incorporated herein by reference for this purpose. The salts can be prepared in situ during the final isolation and purification of the compounds, or separately by reacting the free base function with a suitable organic acid. Examples of pharmaceutically acceptable, nontoxic acid addition salts are salts of an amino group formed with inorganic acids such as hydrochloric acid, hydrobromic acid, phosphoric acid, sulfuric acid and perchloric acid or with organic acids such as acetic acid, oxalic acid, maleic acid, tartaric acid, citric acid, succinic acid or malonic acid or by using other documented methodologies such as ion exchange. Other pharmaceutically acceptable salts include adipate, alginate, ascorbate, aspartate, benzenesulfonate, benzoate, bisulfate, borate, butyrate, camphorate, camphorsulfonate, citrate, cyclopentanepropionate, digluconate, dodecylsulfate, ethanesulfonate, formate, fumarate, glucoheptonate, glycerophosphate, gluconate, hemisulfate, heptanoate, hexanoate, hydroiodide, 2-hydroxy-ethanesulfonate, lactobionate, lactate, laurate, lauryl sulfate, malate, maleate, malonate, methanesulfonate, 2-naphthalenesulfonate, nicotinate, nitrate, oleate, oxalate, palmitate, pamoate, pectinate, persulfate, 3-phenylpropionate, phosphate, picrate, pivalate, propionate, stearate, succinate, sulfate, tartrate, thiocyanate, p-toluenesulfonate, undecanoate, valerate salts, and the like. Representative alkali or alkaline earth metal salts include sodium, lithium, potassium, calcium, magnesium, and the like. Further pharmaceutically acceptable salts include, when appropriate, nontoxic ammonium, quaternary ammonium, and amine cations formed using counterions such as halide, hydroxide, carboxylate, sulfate, phosphate, nitrate, loweralkyl sulfonate and aryl sulfonate.

In embodiments, the compositions are formulated into any of many possible dosage forms such as, but not limited to, tablets, capsules, gel capsules, liquid syrups, soft gels, suppositories, and enemas. In embodiments, the compositions are formulated as suspensions in aqueous, non-aqueous or mixed media. Aqueous suspensions may further contain substances that increase the viscosity of the suspension including, for example, sodium carboxymethylcellulose, sorbitol and/or dextran. The suspension may also contain stabilizers. In embodiments, a pharmaceutical formulation or composition of the present invention includes, but is not limited to, a solution, emulsion, microemulsion, foam or liposome-containing formulation (e.g., cationic or noncationic liposomes).

The pharmaceutical composition or formulation of the present invention may comprise one or more penetration enhancer, carrier, excipients or other active or inactive ingredients as appropriate and well known to those of skill in the art or described in the published literature. In embodiments, liposomes also include sterically stabilized liposomes, e.g., liposomes comprising one or more specialized lipids. These specialized lipids result in liposomes with enhanced circulation lifetimes. In embodiments, a sterically stabilized liposome comprises one or more glycolipids or is derivatized with one or more hydrophilic polymers, such as a polyethylene glycol (PEG) moiety. In embodiments, a surfactant is included in the pharmaceutical formulation or compositions. The use of surfactants in drug products, formulations and emulsions is well known in the art. In embodiments, the present invention employs a penetration enhancer to effect the efficient delivery of the antisense oligonucleotide, e.g., to aid diffusion across cell membranes and/or enhance the permeability of a lipophilic drug. In embodiments, the penetration enhancers are a surfactant, fatty acid, bile salt, chelating agent, or non-chelating non-surfactant.

In embodiments, the pharmaceutical formulation comprises multiple antisense oligonucleotides. In embodiments, the antisense oligonucleotide is administered in combination with another drug or therapeutic agent.

Treatment of Subjects

Any of the compositions provided herein may be administered to an individual. "Individual" may be used interchangeably with "subject" or "patient." An individual may be a mammal, for example a human or animal such as a non-human primate, a rodent, a rabbit, a rat, a mouse, a horse, a donkey, a goat, a cat, a dog, a cow, a pig, or a sheep. In embodiments, the individual is a human. In embodiments, the individual is a fetus, an embryo, or a child. In other embodiments, the individual may be another eukaryotic organism, such as a plant. In some embodiments, the compositions provided herein are administered to a cell ex vivo.

In some embodiments, the compositions provided herein are administered to an individual as a method of treating a disease or disorder. In some embodiments, the individual has a genetic disease, such as any of the diseases described herein. In some embodiments, the individual is at risk of having the disease, such as any of the diseases described herein. In some embodiments, the individual is at increased risk of having a disease or disorder caused by insufficient amount of a protein or insufficient activity of a protein. If an individual is "at an increased risk" of having a disease or disorder caused insufficient amount of a protein or insufficient activity of a protein, the method involves preventative or prophylactic treatment. For example, an individual may be at an increased risk of having such a disease or disorder because of family history of the disease. Typically, individuals at an increased risk of having such a disease or disorder benefit from prophylactic treatment (e.g., by preventing or delaying the onset or progression of the disease or disorder). In embodiments, a fetus is treated in utero, e.g., by administering the ASO composition to the fetus directly or indirectly (e.g., via the mother).

Suitable routes for administration of ASOs of the present invention may vary depending on cell type to which delivery of the ASOs is desired. Multiple tissues and organs are affected by AD mental retardation 5 and Dravet syndrome, with the brain being the most significantly affected tissue. The ASOs of the present invention may be administered to patients parenterally, for example, by intrathecal injection, intracerebroventricular injection, intraperitoneal injection, intramuscular injection, subcutaneous injection, or intravenous injection.

In embodiments, the antisense oligonucleotide is administered with one or more agents capable of promoting penetration of the subject antisense oligonucleotide across the blood-brain barrier by any method known in the art. For example, delivery of agents by administration of an adenovirus vector to motor neurons in muscle tissue is described in U.S. Pat. No. 6,632,427, "Adenoviral-vector-mediated gene transfer into medullary motor neurons," incorporated herein by reference. Delivery of vectors directly to the brain, e.g., the striatum, the thalamus, the hippocampus, or the substantia nigra, is described, e.g., in U.S. Pat. No. 6,756,523, "Adenovirus vectors for the transfer of foreign genes into cells of the central nervous system particularly in brain," incorporated herein by reference.

In embodiments, the antisense oligonucleotides are linked or conjugated with agents that provide desirable pharmaceutical or pharmacodynamic properties. In embodiments, the antisense oligonucleotide is coupled to a substance, known in the art to promote penetration or transport across the blood-brain barrier, e.g., an antibody to the transferrin receptor. In embodiments, the antisense oligonucleotide is linked with a viral vector, e.g., to render the antisense compound more effective or increase transport across the blood-brain barrier. In embodiments, osmotic blood brain barrier disruption is assisted by infusion of sugars, e.g., meso erythritol, xylitol, D(+) galactose, D(+) lactose, D(+) xylose, dulcitol, myo-inositol, L(−) fructose, D(−) mannitol, D(+) glucose, D(+) arabinose, D(−) arabinose, cellobiose, D(+) maltose, D(+) raffinose, L(+) rhamnose, D(+) melibiose, D(−) ribose, adonitol, D(+) arabitol, L(−) arabitol, D(+) fucose, L(−) fucose, D(−) lyxose, L(+) lyxose, and L(−) lyxose, or amino acids, e.g., glutamine, lysine, arginine, asparagine, aspartic acid, cysteine, glutamic acid, glycine, histidine, leucine, methionine, phenylalanine, proline, serine, threonine, tyrosine, valine, and taurine. Methods and materials for enhancing blood brain barrier penetration are described, e.g., in U.S. Pat. No. 9,193,969, "Compositions and methods for selective delivery of oligonucleotide molecules to specific neuron types," U.S. Pat. No. 4,866,042, "Method for the delivery of genetic material across the blood brain barrier," U.S. Pat. No. 6,294,520, "Material for passage through the blood-brain barrier," and U.S. Pat. No. 6,936,589, "Parenteral delivery systems," each incorporated herein by reference.

In embodiments, an ASO of the invention is coupled to a dopamine reuptake inhibitor (DRI), a selective serotonin reuptake inhibitor (SSRI), a noradrenaline reuptake inhibitor (NRI), a norepinephrine-dopamine reuptake inhibitor (NDRI), and a serotonin-norepinephrine-dopamine reuptake inhibitor (SNDRI), using methods described in, e.g., U.S. Pat. No. 9,193,969, incorporated herein by reference.

In embodiments, subjects treated using the methods and compositions are evaluated for improvement in condition using any methods known and described in the art.

Methods of Identifying Additional ASOs that Enhance Splicing

Also within the scope of the present invention are methods for identifying (determining) additional ASOs that enhance splicing of a SYNGAP1 or SCN1A RIC pre-mRNA, specifically at the target intron. ASOs that specifically hybridize to different nucleotides within the target region of the pre-mRNA may be screened to identify (determine) ASOs that improve the rate and/or extent of splicing of the target intron. In some embodiments, the ASO may block or interfere with the binding site(s) of a splicing repressor(s)/silencer. Any method known in the art may be used to identify (determine) an ASO that when hybridized to the target region of the intron results in the desired effect (e.g., enhanced splicing, protein or functional RNA production). These methods also can be used for identifying ASOs that enhance splicing of the retained intron by binding to a targeted region in an exon flanking the retained intron, or in a non-retained intron. An example of a method that may be used is provided below.

A round of screening, referred to as an ASO "walk" may be performed using ASOs that have been designed to hybridize to a target region of a pre-mRNA. For example, the ASOs used in the ASO walk can be tiled every 5 nucleotides from approximately 100 nucleotides upstream of the 5' splice site of the retained intron (e.g., a portion of sequence of the exon located upstream of the target/retained intron) to approximately 100 nucleotides downstream of the 5' splice site of the target/retained intron and/or from approximately 100 nucleotides upstream of the 3' splice site of the retained intron to approximately 100 nucleotides downstream of the 3' splice site of the target/retained intron (e.g., a portion of sequence of the exon located downstream of the target/retained intron). For example, a first ASO of 15 nucleotides in length may be designed to specifically hybridize to nucleotides +6 to +20 relative to the 5' splice site of the target/retained intron. A second ASO is designed to specifically hybridize to nucleotides +11 to +25 relative to the 5' splice site of the target/retained intron. ASOs are designed as such spanning the target region of the pre-mRNA. In embodiments, the ASOs can be tiled more closely, e.g., every 1, 2, 3, or 4 nucleotides. Further, the ASOs can be tiled from 100 nucleotides downstream of the 5' splice site, to 100 nucleotides upstream of the 3' splice site. In some embodiments, the ASOs can be tiled from about 1,160 nucleotides upstream of the 5' splice site, to about 500 nucleotides downstream of the 5' splice site. In some embodiments, the ASOs can be tiled from about 500 nucleotides upstream of the 3' splice site, to about 1,920 nucleotides downstream of the 3' splice site.

One or more ASOs, or a control ASO (an ASO with a scrambled sequence, sequence that is not expected to hybridize to the target region) are delivered, for example by transfection, into a disease-relevant cell line that expresses the target pre-mRNA (e.g., the RIC pre-mRNA described elsewhere herein). The splicing-inducing effects of each of the ASOs may be assessed by any method known in the art, for example by reverse transcriptase (RT)-PCR using primers that span the splice junction, as described herein (see, e.g., Example 1). A reduction or absence of the RT-PCR product produced using the primers spanning the splice junction in ASO-treated cells as compared to in control ASO-treated cells indicates that splicing of the target intron has been enhanced. In some embodiments, the splicing efficiency, the ratio of spliced to unspliced pre-mRNA, the rate of splicing, or the extent of splicing may be improved using the ASOs described herein. The amount of protein or functional RNA that is encoded by the target pre-mRNA can also be assessed to determine whether each ASO achieved the desired effect (e.g., enhanced protein production). Any method known in the art for assessing and/or quantifying protein production, such as Western blotting, flow cytometry, immunofluorescence microscopy, and ELISA, can be used.

A second round of screening, referred to as an ASO "micro-walk" may be performed using ASOs that have been designed to hybridize to a target region of a pre-mRNA. The ASOs used in the ASO micro-walk are tiled every 1 nucleotide to further refine the nucleotide acid sequence of the pre-mRNA that when hybridized with an ASO results in enhanced splicing.

Regions defined by ASOs that promote splicing of the target intron are explored in greater detail by means of an ASO "micro-walk", involving ASOs spaced in 1-nt steps, as well as longer ASOs, typically 18-25 nt.

As described for the ASO walk above, the ASO micro-walk is performed by delivering one or more ASOs, or a control ASO (an ASO with a scrambled sequence, sequence that is not expected to hybridize to the target region), for example by transfection, into a disease-relevant cell line that expresses the target pre-mRNA. The splicing-inducing effects of each of the ASOs may be assessed by any method known in the art, for example by reverse transcriptase (RT)-PCR using primers that span the splice junction, as described herein (see, e.g., Example 1). A reduction or absence of the RT-PCR product produced using the primers spanning the splice junction in ASO-treated cells as compared to in control ASO-treated cells indicates that splicing of the target intron has been enhanced. In some embodiments, the splicing efficiency, the ratio of spliced to unspliced pre-mRNA, the rate of splicing, or the extent of splicing may be improved using the ASOs described herein. The amount of protein or functional RNA that is encoded by the target pre-mRNA can also be assessed to determine whether each ASO achieved the desired effect (e.g., enhanced protein production). Any method known in the art for assessing and/or quantifying protein production, such as Western blotting, flow cytometry, immunofluorescence microscopy, and ELISA, can be used.

ASOs that when hybridized to a region of a pre-mRNA result in enhanced splicing and increased protein production may be tested in vivo using animal models, for example transgenic mouse models in which the full-length human gene has been knocked-in or in humanized mouse models of disease. Suitable routes for administration of ASOs may vary depending on the disease and/or the cell types to which delivery of the ASOs is desired. ASOs may be administered, for example, by intrathecal injection, intracerebroventricular injection, intraperitoneal injection, intramuscular injection, subcutaneous injection, or intravenous injection. Following administration, the cells, tissues, and/or organs of the model animals may be assessed to determine the effect of the ASO treatment by for example evaluating splicing (efficiency, rate, extent) and protein production by methods known in the art and described herein. The animal models may also be any phenotypic or behavioral indication of the disease or disease severity.

While preferred embodiments of the present invention have been shown and described herein, it will be obvious to those skilled in the art that such embodiments are provided by way of example only. Numerous variations, changes, and substitutions will now occur to those skilled in the art without departing from the invention. It should be understood that various alternatives to the embodiments of the invention described herein may be employed in practicing the invention. It is intended that the following claims define the scope of the invention and that methods and structures within the scope of these claims and their equivalents be covered thereby.

EXAMPLES

The present invention will be more specifically illustrated by the following Examples. However, it should be understood that the present invention is not limited by these examples in any manner.

Figure 3:
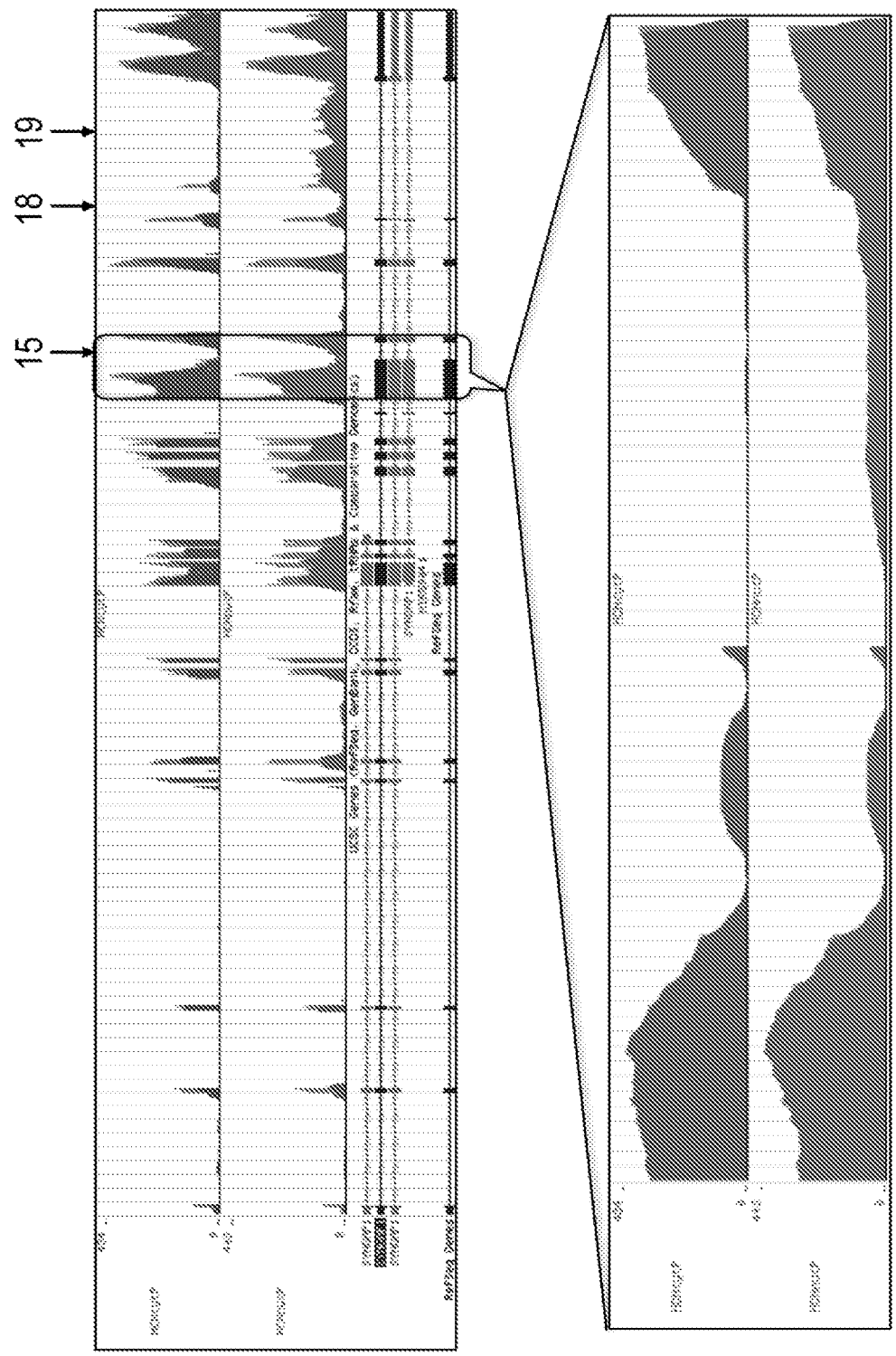
FIG. 3 depicts intron-retention in the SYNGAP1 gene with intron 15 shown in detail. The identification of intron-retention events in the SYNGAP1 gene using RNA sequencing (RNAseq) is shown, visualized in the UCSC genome browser. The upper panel shows the read density corresponding to the SYNGAP1 transcript expressed in HCN (human cortical neurons) and localized in either the cytoplasmic (top) or nuclear fraction (bottom). At the bottom of this panel, a graphic representation of the SYNGAP1 gene is shown to scale. The read density is shown as peaks. The highest read density corresponds to exons (black boxes), while no reads are observed for the majority of the introns (lines with arrow heads) in either cellular fraction. Higher read density is detected for introns 15 and 18/19 (pointed by the arrows) in the nuclear fraction compared to the cytoplasmic fraction indicating that splicing efficiency of introns 15 and 18/19 is low, resulting in intron retention. The retained-intron containing pre-mRNA transcripts are retained in the nucleus and are not exported out to the cytoplasm. The read density for intron 15 in HCN is shown in detail in the lower panel indicating 25% intron retention as calculated by bioinformatic analysis.
Figure 5:
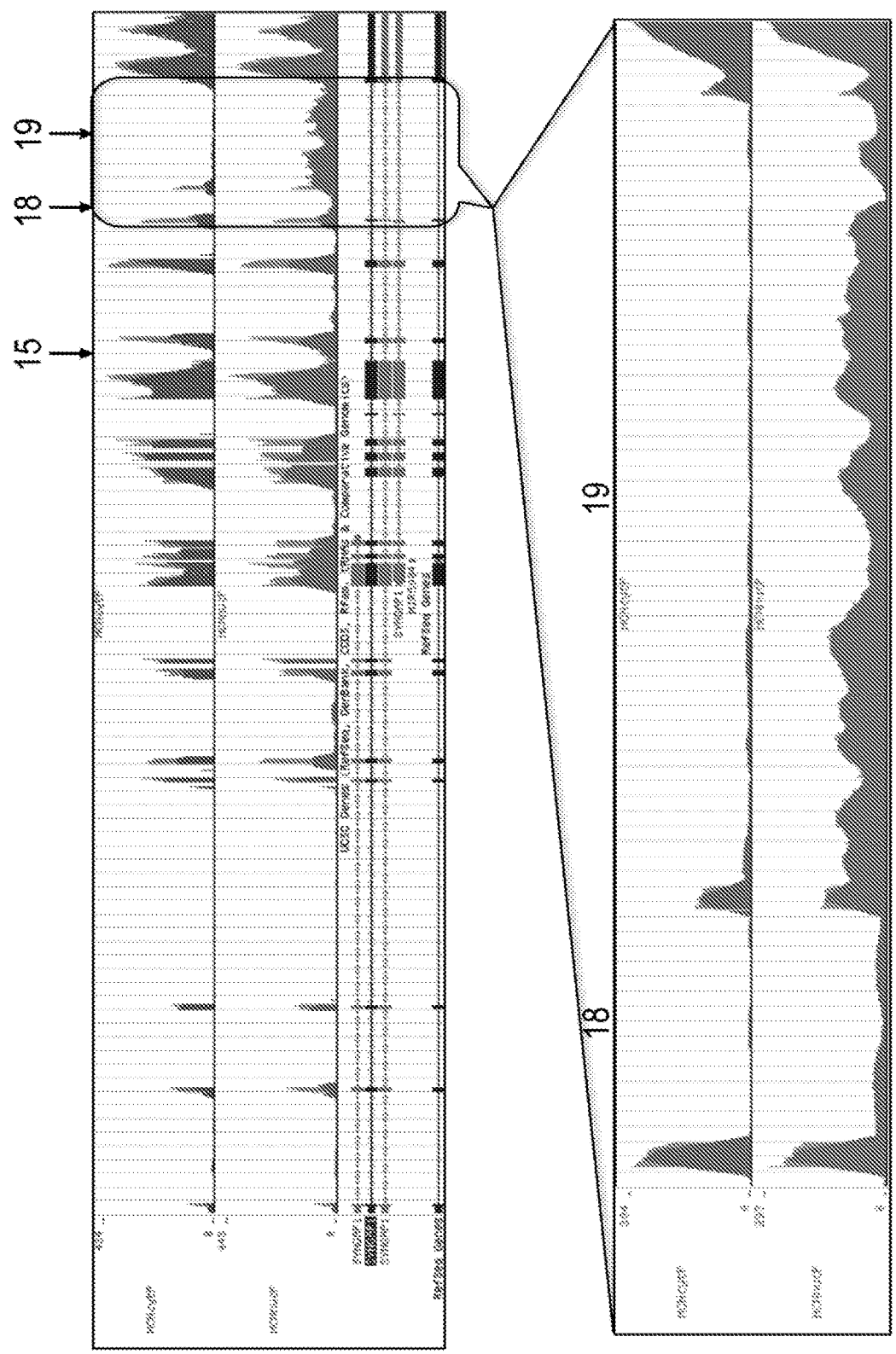
FIG. 5 depicts intron-retention in the SYNGAP1 gene with introns 18 and 19 shown in detail. Intron retention in the SYNGAP1 gene was identified by RNA sequencing (RNAseq), visualized in the UCSC genome browser, as described herein in the Examples. The read density for introns 18 and 19 in HCN is shown in detail in the lower panel. Introns 18 and 19 flank exon 19, an alternatively spliced exon. Even though exon 19 is not annotated, evidence of its existence is shown by the RNAseq data, such that a clear peak is observed in the cytoplasmic fraction; however the read density corresponding to exon 19 in the cytoplasmic fraction is lower than that of the constitutively spliced exons in SYNGAP1. The read density for intron 18/19 in HCN is shown in detail in the lower panel indicating 42% intron retention as calculated by bioinformatic analysis.

Example 1: Identification of Intron Retention Events in SYNGAP1 Transcripts by RNAseq Using Next Generation Sequencing Whole transcriptome shotgun sequencing was carried out using next generation sequencing to reveal a snapshot of transcripts produced by the SYNGAP1 gene to identify intron-retention events. For this purpose, polyA+ RNA from nuclear and cytoplasmic fractions of HCN (human cortical neurons) was isolated and cDNA libraries constructed using Illumina's TruSeq Stranded mRNA library Prep Kit. The libraries were pair-end sequenced resulting in 100-nucleotide reads that were mapped to the human genome (February 2009, GRCh37/hg19 assembly). The sequencing results for SYNGAP1 are shown in FIG. 3. Briefly, FIG. 3 shows the mapped reads visualized using the UCSC genome browser (operated by the UCSC Genome Informatics Group (Center for Biomolecular Science & Engineering, University of California, Santa Cruz, 1156 High Street, Santa Cruz, Calif. 95064) and described by, e.g., Rosenbloom, et al., 2015, "The UCSC Genome Browser database: 2015 update," Nucleic Acids Research 43, Database Issue, doi: 10.1093/nar/gku1177) and the coverage and number of reads can be inferred by the peak signals. The height of the peaks indicates the level of expression given by the density of the reads in a particular region. A schematic representation of SYNGAP1 (drawn to scale) is provided by the UCSC genome browser (below the read signals) so that peaks can be matched to SYNGAP1 exonic and intronic regions. Based on this display, we identified three introns (15, 18 and 19 indicated by arrows; corresponding to NM_006772 intron 15, NM_006772 intron 18, and NM_006772 intron 19, respectively) that have high read density in the nuclear fraction of HCN, but have very low to no reads in the cytoplasmic fraction of these cells (as shown for intron 15 in the bottom diagram of FIG. 3 and for introns 18 and 19 in the bottom diagram of FIG. 5). This indicates that these introns are retained and that the intron-15, intron-18, and intron-19 containing transcripts remain in the nucleus, and suggests that these retained SYNGAP1 RIC pre-mRNAs are non-productive, as they are not exported out to the cytoplasm.

Example 2: Design of ASO-Walk Targeting Intron 15 of SYNGAP1

Figure 4:
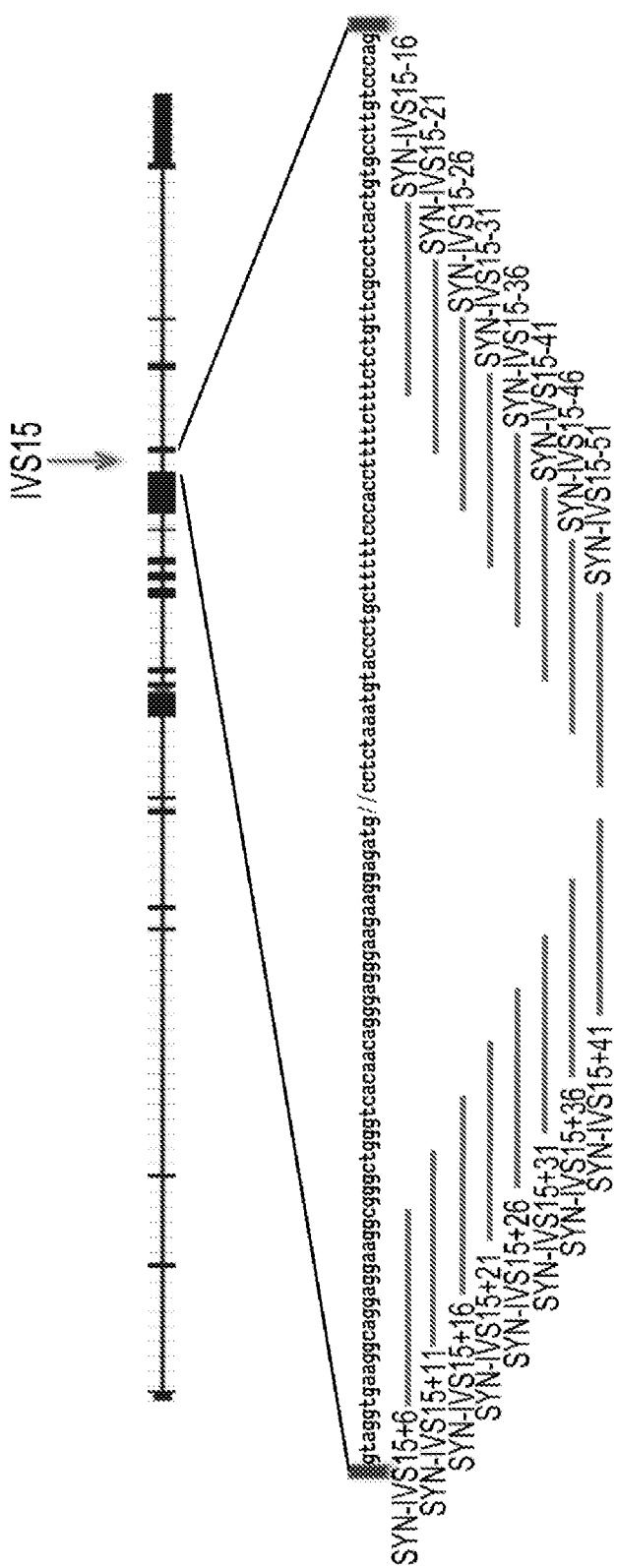
FIG. 4 depicts an exemplary SYNGAP1 gene intron 15 (IVS15) ASO walk. A graphic representation of the ASO walk performed for SYNGAP1 IVS 15 targeting sequences immediately downstream of the 5' splice site or upstream of the 3' splice site using 2'-O-Me ASOs, PS backbone, is shown. ASOs were designed to cover these regions by shifting 5 nucleotides at a time. The SYNGAP1 exon-intron structure is drawn to scale. Figure discloses SEQ ID NOS 2615 and 2616, respectively, in order of appearance.
Figure 7A:
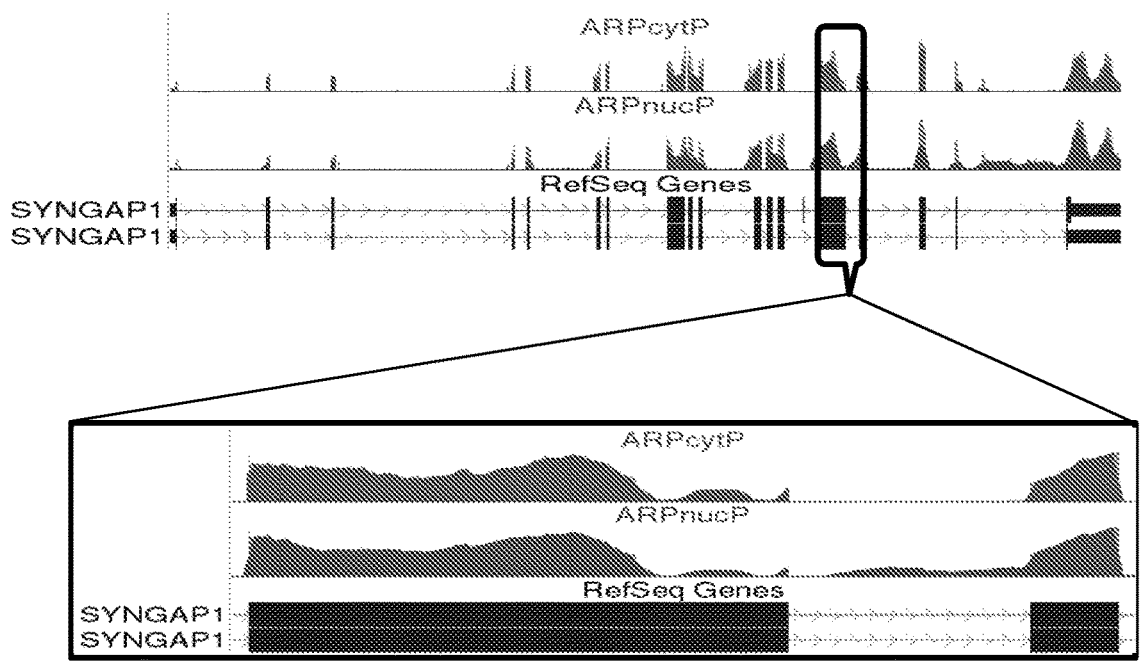
FIG. 7A depicts a schematic of the RefSeq Genes for SYNGAP1 corresponding to NM_006772.
Figure 7B:
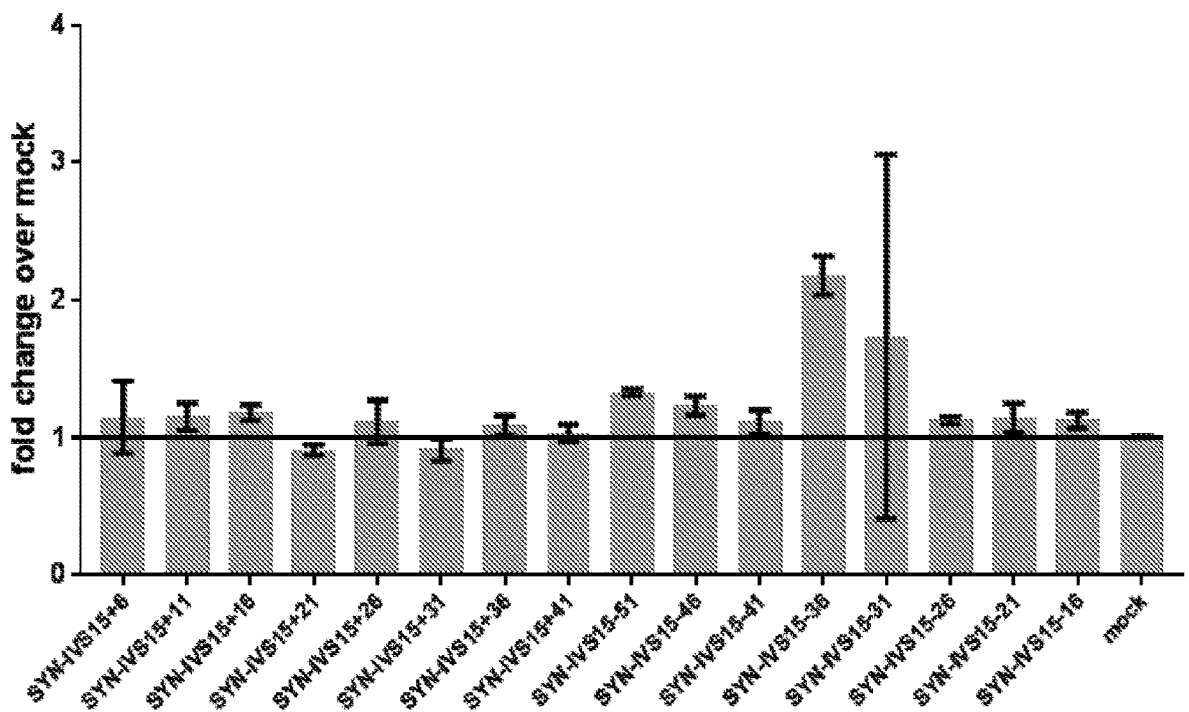
FIG. 7B depicts an exemplary graph showing the average (n=3) fold change in expression levels of SYNGAP1 mRNA without intron 15 in ARPE-19 cells treated for 24 hrs with 80 nM of the indicated ASOs over mock treated cells. Data is normalized to RPL32 expression.
Figure 7C:
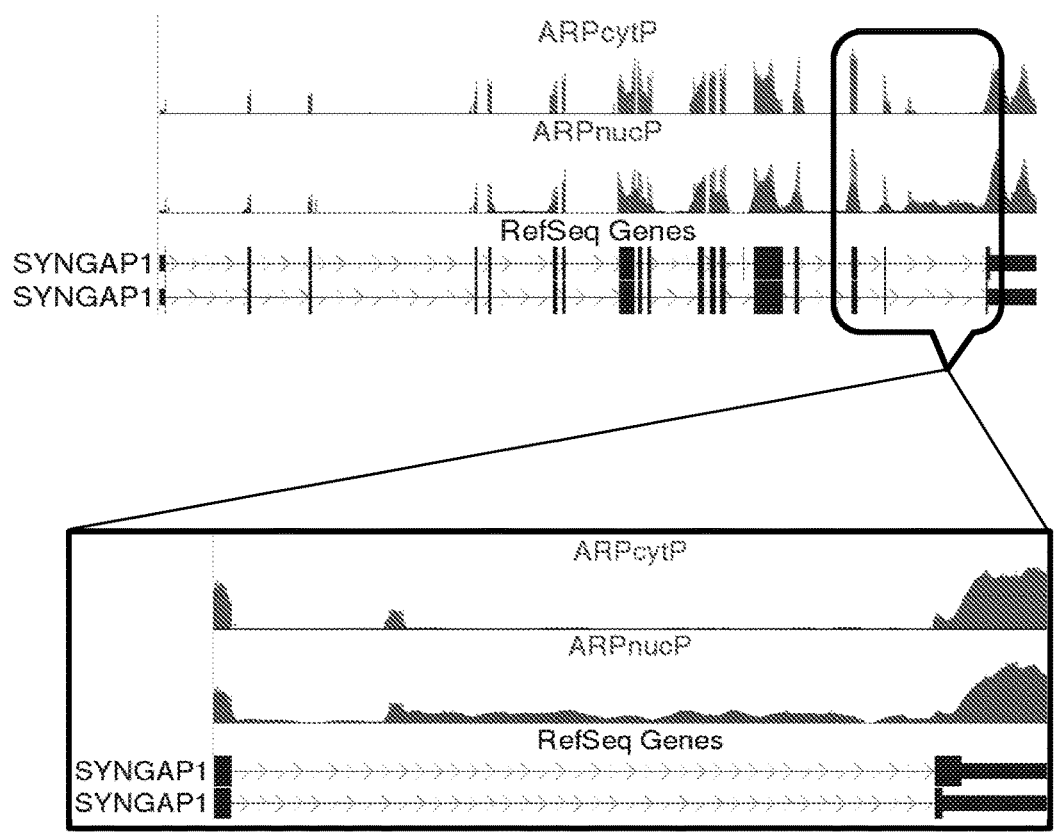
FIG. 7C depicts a schematic of the RefSeq Genes for SYNGAP1 corresponding to NM_006772.

An ASO walk was designed to target intron 15 using the method described herein (FIG. 4; Table 1, SEQ ID NOs: 1510 to 1814 and 2287 to 2591). A region immediately upstream and downstream of the intron 15 5' splice site spanning nucleotides +251 to −1,054e and a region immediately upstream and downstream of intron 15 3' splice site spanning nucleotides −256 to +157e were utilized to design ASOs to target retained intron 15 SYNGAP1 RIC pre-mRNAs. Table 1 lists exemplary ASOs that were designed and their target sequences. From this design, 2'-O-Me RNA, PS backbone, 18-mer ASOs shifted by 5-nucleotide intervals were produced and utilized to target SYNGAP1 RIC pre-mRNAs to increase SYNGAP1 protein production (see FIG. 4 and FIG. 7B).

according to vendor's specifications. Briefly, ASOs were plated in 96-well tissue culture plates and combined with RNAiMax diluted in Opti-MEM. Cells were detached using trypsin and resuspended in full medium, and approximately 25,000 cells were added the ASO-transfection mixture. Transfection experiments were carried out in triplicate plate replicates. Final ASO concentration was 80 nM. Media was changed 6 h post-transfection, and cells harvested at 24 h, using the Cells-to-Ct lysis reagent, supplemented with DNAse (Thermo Fisher), according to vendor's specifications. cDNA was generated with Cells-to-Ct RT reagents (Thermo Fisher) according to vendor's specifications. To quantify the amount of splicing at the intron of interest, quantitative PCR was carried out using Taqman assays with probes spanning the corresponding exon-exon junction (Thermo Fisher). Taqman assays were carried out according to vendor's specifications, on a QuantStudio 7 Flex Real-Time PCR system (Thermo Fisher). Target gene assay values were normalized to RPL32 (deltaCt) and plate-matched mock transfected samples (delta-delta Ct), gener-

TABLE 1

List of ASOs targeting SYNGAP1

| Gene SEQ ID NO: | Pre-mRNA SEQ ID NO: | ASOs | Retained Intron | Target Sequence SEQ ID NO: |
|---|---|---|---|---|
| SYNGAP1 SEQ ID NO. 2 | SYNGAP1: NM_006772 SEQ ID NO. 8 | SEQ ID NOs: 1038-1509 | Intron 18 | SEQ ID NO: 2594 |
| | | SEQ ID NOs: 1510-1814 | Intron 15 | SEQ ID NO: 2592 |
| SYNGAP1 SEQ ID NO. 3 | SYNGAP1: NM_006772 SEQ ID NO. 9 | SEQ ID NOs: 1815-2286 | Intron 18 | SEQ ID NO: 2595 |
| | | SEQ ID NOs: 2287-2591 | Intron 15 | SEQ ID NO: 2592 |

Example 3: Design of ASO-Walk Targeting Intron 18 and 19 of SYNGAP1

Figure 6:
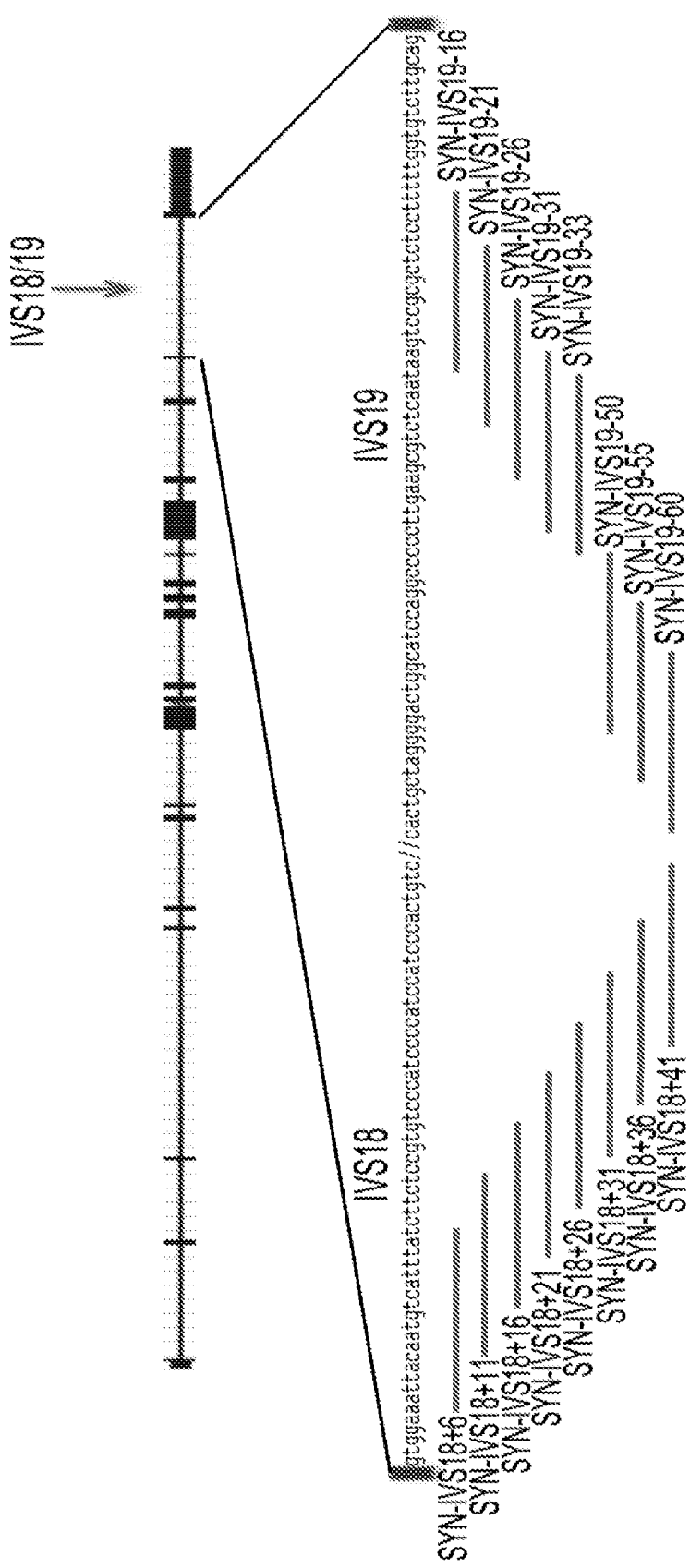
FIG. 6 depicts an exemplary SYNGAP1 gene intron 18 (IVS18) and intron 19 (IVS19) ASO walk. A graphic representation of the ASO walk performed for SYNGAP1 IVS 18 and 19 targeting sequences immediately downstream of the 5' splice site of intron 18 or upstream of the 3' splice site of intron 19 using 2'-O-Me ASOs, PS backbone, is shown. The splice site intronic regions flanking alternative exon 19 are not targeted to avoid affecting the inclusion level of exon 19. ASOs were designed to cover these regions by shifting 5 nucleotides at a time. The SYNGAP1 exon-intron structure is drawn to scale. Figure discloses SEQ ID NOS 2617 and 2618, respectively, in order of appearance.
Figure 7D:
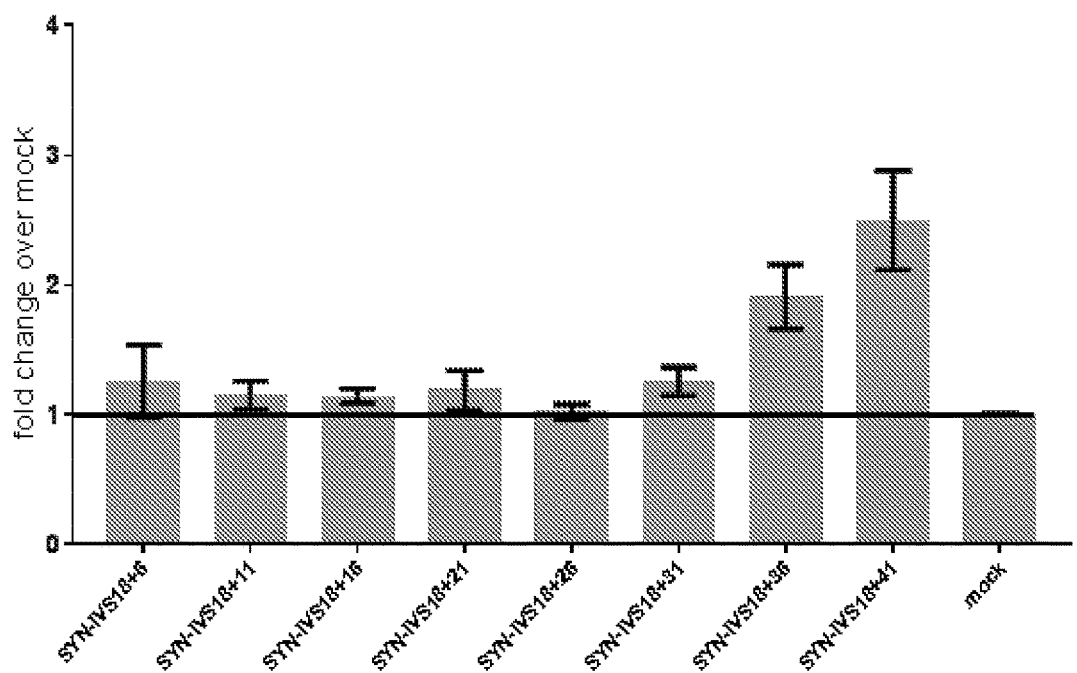
FIG. 7D depicts an exemplary graph showing the average (n=3) fold change in expression levels of SYNGAP1 mRNA without intron 18 in ARPE-19 cells treated for 24 hrs with 80 nM of the indicated ASOs over mock treated cells. Data is normalized to RPL32 expression.
Figure 7E:
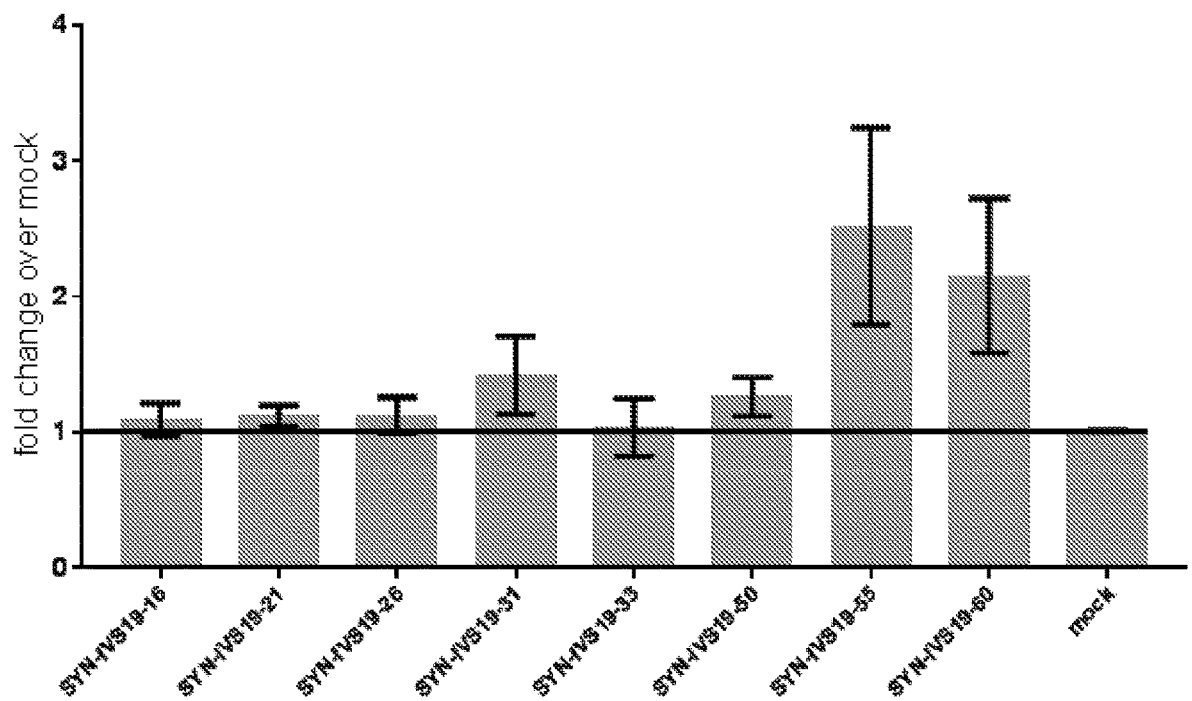
FIG. 7E depicts an exemplary graph showing the average (n=3) fold change in expression levels of SYNGAP1 mRNA without intron 18 in ARPE-19 cells treated for 24 hrs with 80 nM of the indicated ASOs over mock treated cells. Data is normalized to RPL32 expression.

An ASO walk was designed to target introns 18 and 19 using the method described herein (FIG. 6; Table 1, SEQ ID NOs: 1815 to 2286 and 1038 to 1509). A region immediately upstream and downstream of the intron 18 5' splice site spanning nucleotides +499 to −73e to and a region immediately upstream and downstream of the intron 19 3' splice site spanning nucleotides −496 to +1,912e were utilized to design ASOs to target retained intron 18 or 19 SYNGAP1 RIC pre-mRNAs. Table 1 lists exemplary ASOs that were designed and their target sequences. From this design, 2'-O-Me RNA, PS backbone, 18-mer ASOs shifted by 5-nucleotide intervals were produced and utilized to target SYNGAP1 RIC pre-mRNAs to increase SYNGAP1 protein production (see FIG. 6 and FIGS. 7D-E). The splice site intronic regions flanking alternative exon 19 are not targeted to avoid affecting the inclusion level of exon 19.

Example 4: Improved Splicing Efficiency Via ASO-Targeting of SYNGAP1 Introns 15, 18, or 19 Increases Transcript Levels To determine an increase in target gene intron splicing efficiency with ASOs we used the method described herein. ARPE-19 cells, a human retinal epithelium cell line (American Type Culture Collection (ATCC), USA) were mock-transfected, or transfected with the targeting ASOs described in Examples 2 and 3. Cells were transfected using Lipofectamine RNAiMax transfection reagent (Thermo Fisher)

ating fold-change over mock quantitation (2^−(delta-deltaCt). Average fold-change over mock of the three plate replicates for ASOs targeting retained intron 15 is plotted in FIG. 7B. ASOs targeted to positions −31 and −36 demonstrated increased target gene expression by >1.5-fold, implying an increase in splicing at that target intron. Average fold-change over mock of the three plate replicates for ASOs targeting retained intron 18 is plotted in FIG. 7D. ASOs targeted to positions +36 and +41 demonstrated increased target gene expression by >~2-fold, implying an increase in splicing at that target intron. Average fold-change over mock of the three plate replicates for ASOs targeting retained intron 19 is plotted in FIG. 7E. ASOs targeted to positions −55 and −60 demonstrated increased target gene expression by >2-fold, implying an increase in splicing at that target intron. Together with whole transcriptome data confirming retention of the target intron (Example 1), these results confirm that ASOs can improve the splicing efficiency of a rate limiting intron.

Figure 8A:
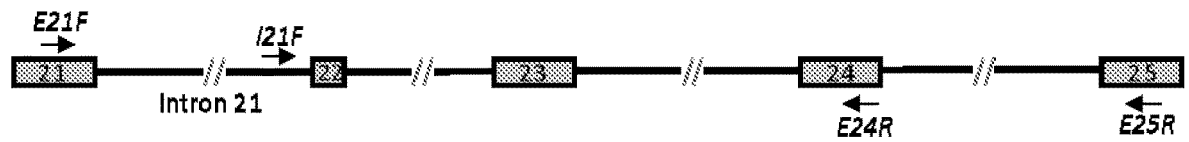
FIG. 8A depicts a schematic of a portion of the RefSeq Gene for SCN1A corresponding to NM 006920. Primers used for the RT-PCR assay in FIG. 8B and FIG. 8C are shown.
Figure 8B:
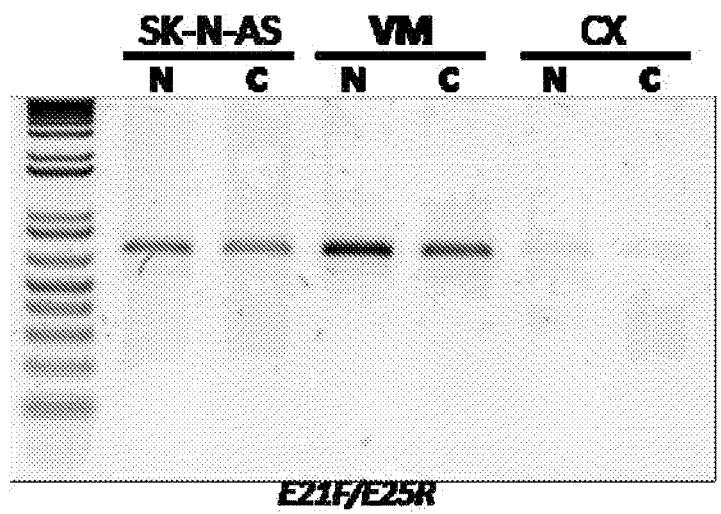
FIG. 8B depicts an agarose gel showing expression levels of SCN1A mRNA as measured by RT-PCR in the indicated cells (VM and CX: ReNcell Neuroprogenitor cells; SK-N-AS: Neuroblastoma cells; C: cytoplasmic fraction; N: nuclear fraction).
Figure 8C:
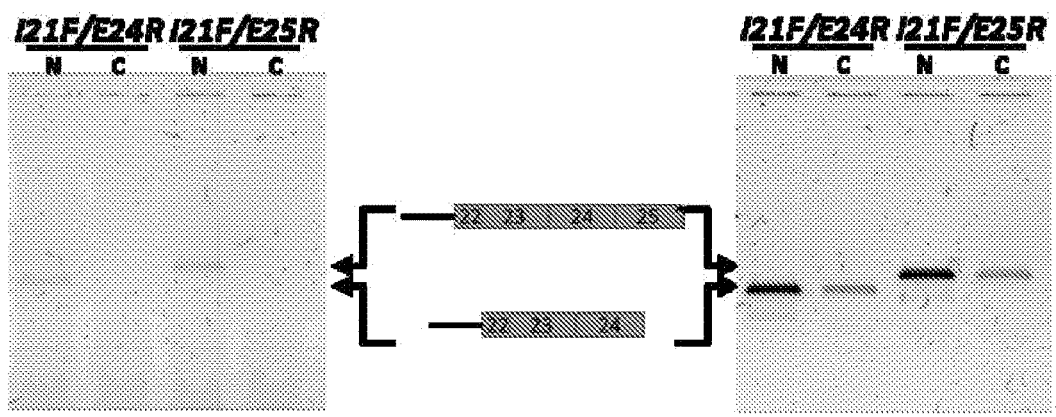
FIG. 8C depicts an agarose gel showing intron 21 retention levels in SK-N-AS cells (left) and VM cells (right) as measured by RT-PCR (VM and CX: ReNcell Neuroprogenitor cells; SK-N-AS: Neuroblastoma cells; C: cytoplasmic fraction; N: nuclear fraction).

Example 5: Identification of Intron Retention Events in SCN1A Transcripts by RNAseq Using Next Generation Sequencing SCN1A intron 21 retention was confirmed using an RT-PCR assay described in FIG. 8C. Intron 21 is retained in SK-N-AS and RenCell VM cells indicated by the presence of a band in the nuclear fraction.

Example 6: Design of ASO-Walk Targeting Intron 21 of SCN1A

Figure 8D:
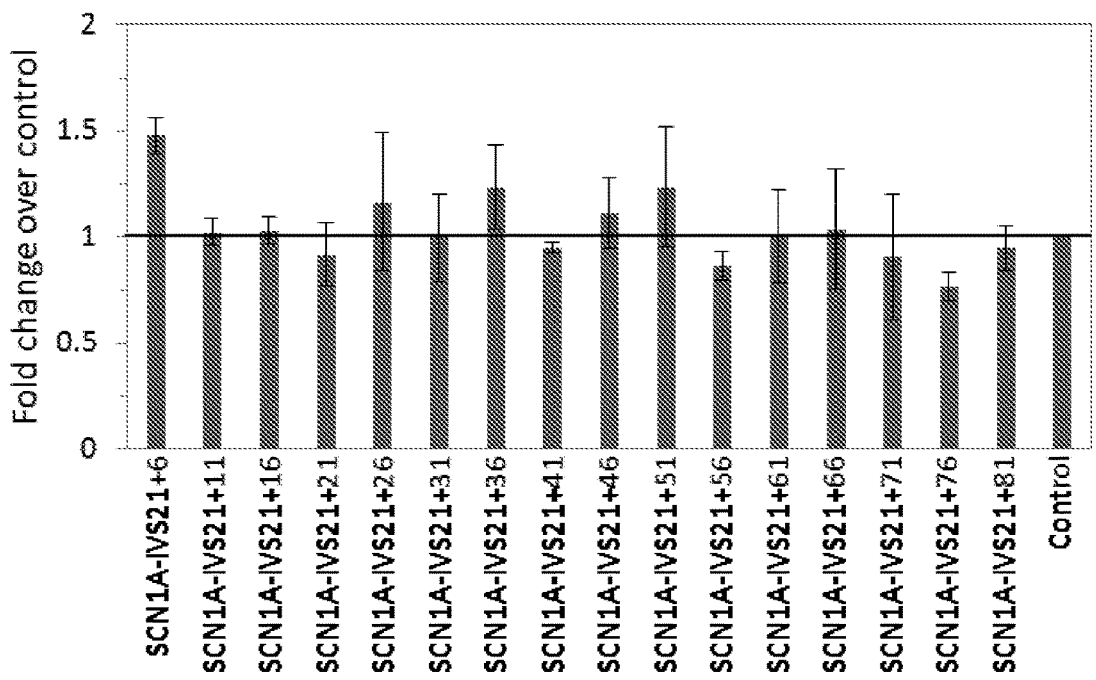
FIG. 8D depicts an exemplary graph showing the average (n=2) fold change in expression levels of SCN1A mRNA without intron 21 in SK-N-AS cells treated for 24 hrs with 80 nM of the indicated ASOs over mock treated cells. Data is normalized to RPL32 expression.
Figure 8E:
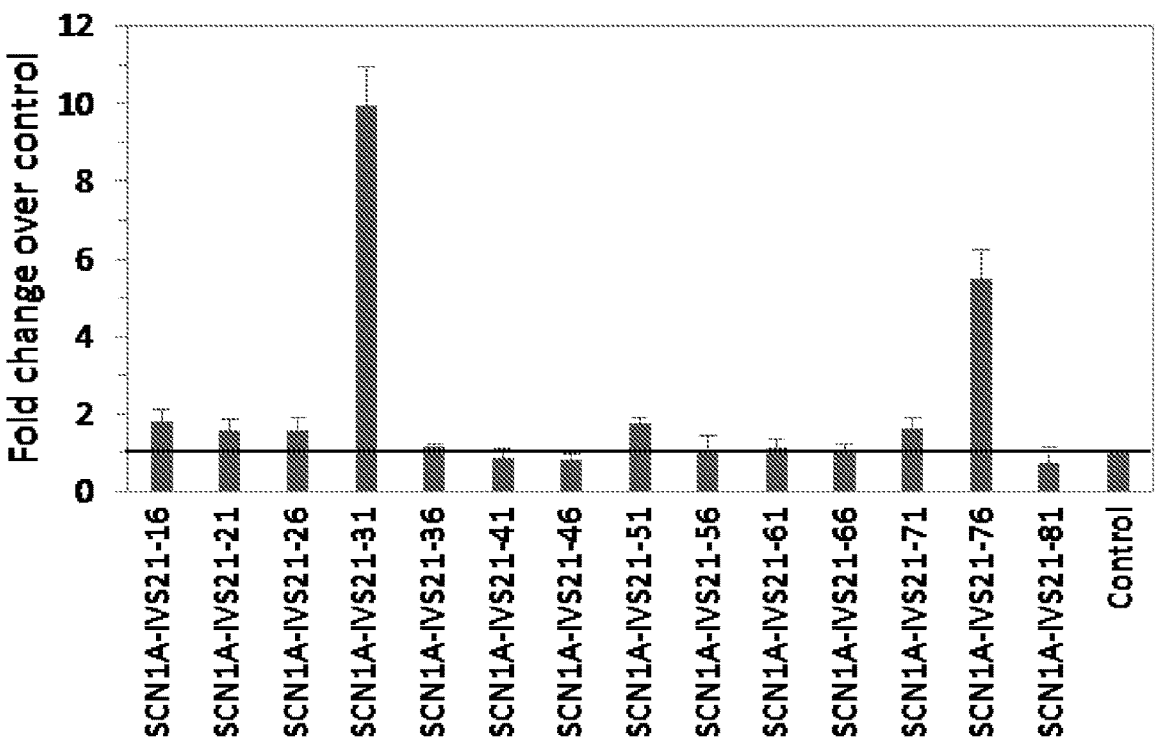
FIG. 8E depicts an exemplary graph showing the average (n=2) fold change in expression levels of SCN1A mRNA without intron 21 in SK-N-AS cells treated for 24 hrs with 80 nM of the indicated ASOs over mock treated cells. Data is normalized to RPL32 expression.
Figure 8F:
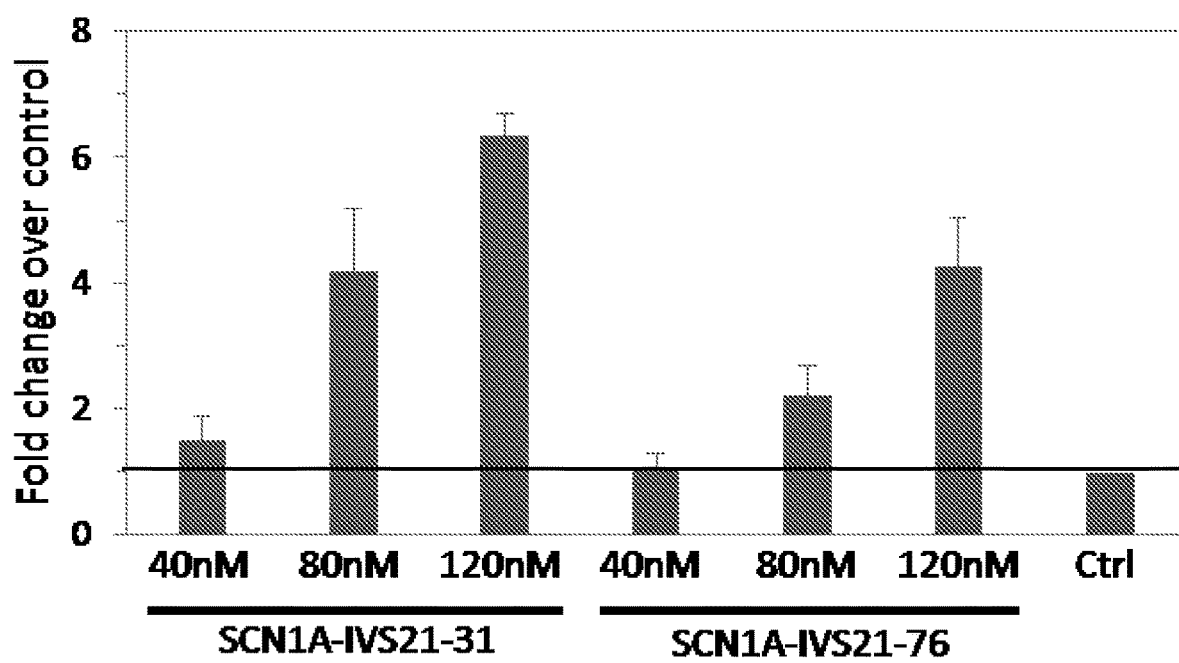
FIG. 8F depicts an exemplary graph showing the average (n=2) fold change in expression levels of SCN1A mRNA without intron 21 in SK-N-AS cells treated for 24 hrs with 40 nM, 80 nM or 120 nM of the indicated ASOs (spanning the exon 21-exon 22 splice junction) over mock treated cells. Data is normalized to RPL32 expression.
Figure 8G:
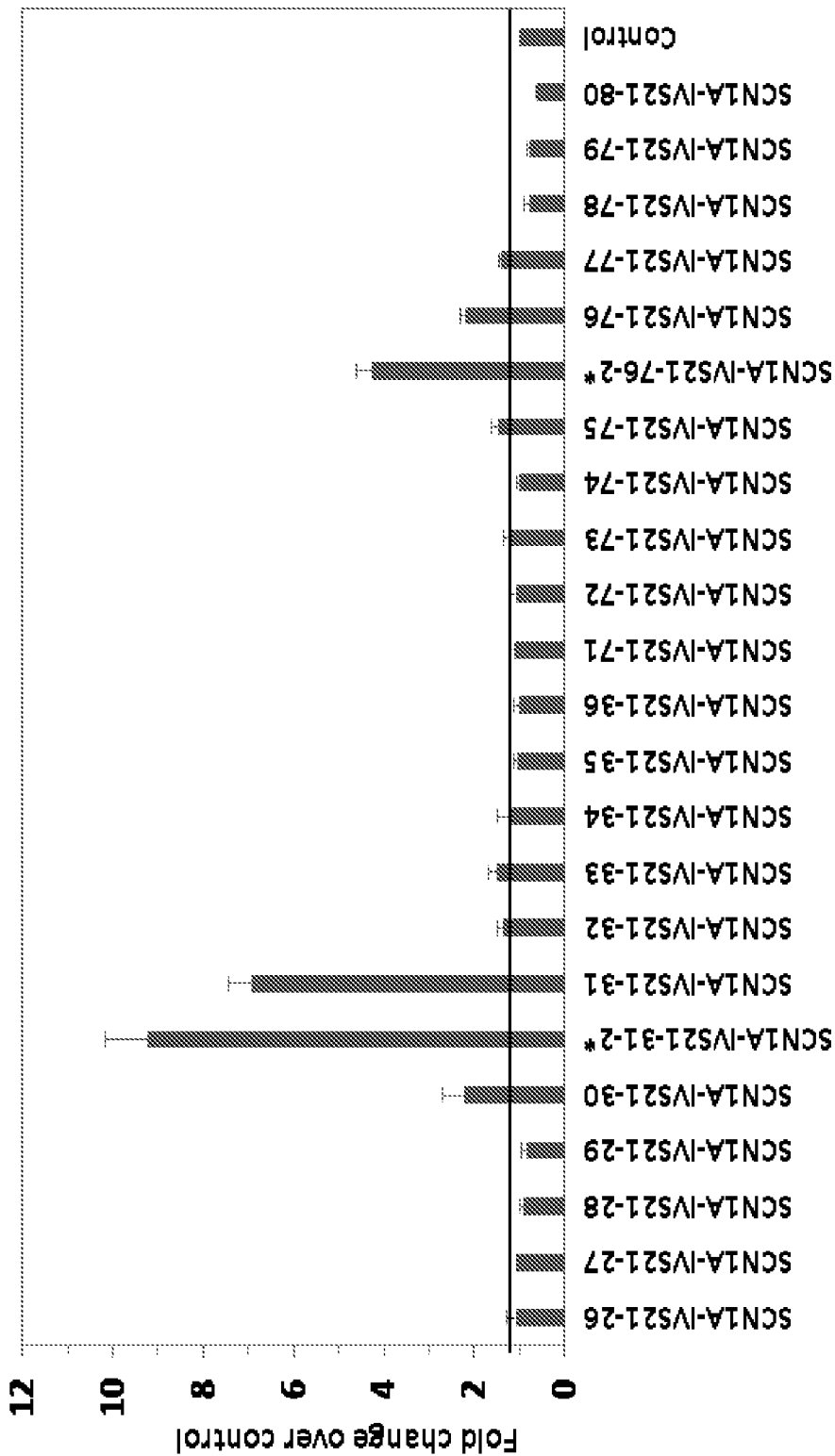
FIG. 8G depicts an exemplary graph showing the average (n=2) fold change in expression levels of SCN1A mRNA without intron 21 in SK-N-AS cells treated for 24 hrs with 80 nM of the indicated ASOs over mock treated cells. Data is normalized to RPL32 expression.

An ASO walk was designed to target intron 21 using the method described herein (Table 2, SEQ ID NOs: 10-266 and 524-1037). A region immediately upstream and downstream of the intron 21 5' splice site spanning nucleotides −264e to +496 and a region immediately upstream and downstream of intron 21 3' splice site spanning nucleotides −496 to +37e were utilized to design ASOs to target retained intron 21 SCN1A RIC pre-mRNAs. Table 2 lists exemplary ASOs that were designed and their target sequences. From this design, 2'-O-Me RNA, PS backbone, 18-mer ASOs shifted by 5-nucleotide intervals were be produced and utilized to target SCN1A RIC pre-mRNAs to increase SCN1A protein production (see FIGS. 8D-E, Table 3-4).

TABLE 2

List of ASOs targeting SCN1A

| Gene SEQ ID NO: | Pre-mRNA SEQ ID NO: | ASOs | Retained Intron | Target Sequence SEQ ID NO: |
|---|---|---|---|---|
| SCN1A SEQ ID NO. 1 | SCN1A: NM_006920 SEQ ID NO. 4 | SEQ ID NOs: 10-266 | Intron 21 | SEQ ID NO: 2593 |
| | SCN1A: NM_001202435 SEQ ID NO. 5 | SEQ ID NOs: 267-523 | Intron 23 | SEQ ID NO: 2593 |
| | SCN1A: NM_001165964 SEQ ID NO. 6 | SEQ ID NOs: 524-780 | Intron 21 | SEQ ID NO: 2593 |
| | SCN1A: NM_001165963 SEQ ID NO. 7 | SEQ ID NOs: 781-1037 | Intron 21 | SEQ ID NO: 2593 |

TABLE 3

SCN1A Intron 21 ASO Macrowalk

| SEQ ID NO: | Name | Sequence (5'-3') | Retained Intron |
|---|---|---|---|
| 63 | SCN1A-IVS21+6 | CAGAGAAAAUAGUGUUCA | 21 |
| 64 | SCN1A-IVS21+11 | AUAUUCAGAGAAAAUAGU | 21 |
| 65 | SCN1A-IVS21+16 | UAAAAAUAUUCAGAGAAA | 21 |
| 66 | SCN1A-IVS21+21 | AACAAUAAAAAUAUUCAG | 21 |
| 67 | SCN1A-IVS21+26 | UUCCAAACAAUAAAAAUA | 21 |
| 68 | SCN1A-IVS21+31 | UAUUAUUCCAAACAAUAA | 21 |
| 69 | SCN1A-IVS21+36 | UUUGUUAUUAUUCCAAAC | 21 |
| 70 | SCN1A-IVS21+41 | AUUAUUUGUUAUUAUUC | 21 |
| 71 | SCN1A-IVS21+46 | AUGUCAUUAUUUGUUAU | 21 |
| 72 | SCN1A-IVS21+51 | GAUGUAUGUCAUUAUUUU | 21 |
| 73 | SCN1A-IVS21+56 | UAAUAGAUGUAUGUCAUU | 21 |
| 74 | SCN1A-IVS21+61 | CUAAAUAAUAGAUGUAUG | 21 |
| 75 | SCN1A-IVS21+66 | AGGAACUAAAUAAUAGAU | 21 |
| 76 | SCN1A-IVS21+71 | UUCUUAGGAACUAAAUAA | 21 |
| 77 | SCN1A-IVS21+76 | ACUUUUCUUAGGAACUA | 21 |
| 78 | SCN1A-IVS21+81 | UAUAUACUUUUCUUAGG | 21 |
| 258 | SCN1A-IVS21-16 | UGCAUGUUUUACUUUGGA | 21 |
| 257 | SCN1A-IVS21-21 | GUUUUACUUUGGAGUAAA | 21 |
| 256 | SCN1A-IVS21-26 | ACUUUGGAGUAAAAAUAA | 21 |
| 255 | SCN1A-IVS21-31 | GGAGUAAAAAUAAUUUAG | 21 |
| 254 | SCN1A-IVS21-36 | AAAAAUAAUUUAGACCUG | 21 |
| 253 | SCN1A-IVS21-41 | UAAUUUAGACCUGAUGUU | 21 |
| 252 | SCN1A-IVS21-46 | UAGACCUGAUGUUUAAUA | 21 |
| 251 | SCN1A-IVS21-51 | CUGAUGUUUAAUAAAUAU | 21 |
| 250 | SCN1A-IVS21-56 | GUUUAAUAAAUAUUCUUA | 21 |
| 249 | SCN1A-IVS21-61 | AUAAAUAUUCUUACUGAU | 21 |
| 248 | SCN1A-IVS21-66 | UAUUCUUACUGAUAUAAU | 21 |
| 247 | SCN1A-IVS21-71 | UUACUGAUAUAAUUUUCA | 21 |
| 246 | SCN1A-IVS21-76 | GAUAUAAUUUUCAAAAGG | 21 |
| 245 | SCN1A-IVS21-81 | AAUUUUCAAAGGGAAUA | 21 |

TABLE 4

SCN1A Intron 21 ASO Microwalk

| SEQ ID NO: | Name | Sequence (5'-3') | Retained Intron |
|---|---|---|---|
| 2596 | SCN1A-IVS21-27 | CUUUGGAGUAAAAAUAAU | 21 |
| 2597 | SCN1A-IVS21-28 | UUUGGAGUAAAAAUAAUU | 21 |
| 2598 | SCN1A-IVS21-29 | UUGGAGUAAAAAUAAUUU | 21 |
| 2599 | SCN1A-IVS21-30 | UGGAGUAAAAAUAAUUUA | 21 |
| 2600 | SCN1A-IVS21-32 | GAGUAAAAAUAAUUUAGA | 21 |
| 2601 | SCN1A-IVS21-33 | AGUAAAAAUAAUUUAGAC | 21 |

TABLE 4 -continued

SCN1A Intron 21 ASO Microwalk

| SEQ ID NO: | Name | Sequence (5'-3') | Retained Intron |
|---|---|---|---|
| 2602 | SCN1A-IVS21-34 | GUAAAAAUAAUUUAGACC | 21 |
| 2603 | SCN1A-IVS21-35 | UAAAAAUAAUUUAGACCU | 21 |
| 2604 | SCN1A-IVS21-72 | UACUGAUAUAAUUUUCAA | 21 |
| 2605 | SCN1A-IVS21-73 | ACUGAUAUAAUUUUCAAA | 21 |
| 2606 | SCN1A-IVS21-74 | CUGAUAUAAUUUUCAAAA | 21 |
| 2607 | SCN1A-IVS21-75 | UGAUAUAAUUUUCAAAAG | 21 |
| 2608 | SCN1A-IVS21-77 | AUAUAAUUUUCAAAAGGG | 21 |
| 2609 | SCN1A-IVS21-78 | UAUAAUUUUCAAAAGGGA | 21 |
| 2610 | SCN1A-IVS21-79 | AUAAUUUUCAAAAGGGAA | 21 |
| 2611 | SCN1A-IVS21-80 | UAAUUUUCAAAAGGGAAU | 21 |

Example 7: Design of ASO-Walk Targeting Intron 23 of SCN1A

An ASO walk can be designed to target intron 23 using the methods described herein (Table 2, SEQ ID NOs: 267-523). A region immediately upstream and downstream of the intron 23 5' splice site spanning nucleotides −264e to +496 and a region immediately upstream and downstream of intron 23 3' splice site spanning nucleotides −496 to +37e are utilized to design ASOs to target retained intron 23 SCN1A RIC pre-mRNAs. Table 2 lists exemplary ASOs that are designed and their target sequences. From this design, 2'-O-Me RNA, PS backbone, 18-mer ASOs shifted by 5-nucleotide intervals can be produced and utilized to target SCN1A RIC pre-mRNAs to increase SCN1A protein production.

Example 8: Improved Splicing Efficiency Via ASO-Targeting of SCN1A Retained Introns Increases Transcript Levels To determine whether we can achieve an increase in SCN1A expression by improving splicing efficiency of SCN1A intron 21 using ASOs, RT-PCR products are evaluated by Taqman RT-qPCR. To this end, cells are mock-transfected, or transfected with ASOs described for intron 21 in Table 3, independently, using RNAiMAX (Invitrogen) delivery reagent. Experiments are performed using 80 nM ASOs for 24 hrs. To quantify the amount of splicing at the intron of interest, quantitative PCR was carried out using Taqman assays with probes spanning the corresponding exon-exon junction (Thermo Fisher). Taqman assays were carried out according to vendor's specifications, on a QuantStudio 7 Flex Real-Time PCR system (Thermo Fisher). Target gene assay values were normalized to RPL32 (deltaCt) and plate-matched mock transfected samples (delta-delta Ct), generating fold-change over mock quantitation (2^−(delta-deltaCt). Average fold-change over mock of the three plate replicates is plotted in FIGS. 8D-E. Several ASOs were identified that increase the target gene expression by >~1.25-fold implying an increase in splicing at that target intron.

While preferred embodiments of the present invention have been shown and described herein, it will be obvious to those skilled in the art that such embodiments are provided by way of example only. Numerous variations, changes, and substitutions will now occur to those skilled in the art without departing from the invention. It should be understood that various alternatives to the embodiments of the invention described herein may be employed in practicing the invention. It is intended that the following claims define the scope of the invention and that methods and structures within the scope of these claims and their equivalents be covered thereby.

SEQUENCE LISTING (2618 sequences)

SEQ ID NO: 1 - DNA, 84480 bp, Homo sapiens
aatgtgcaggatgacaagatggagcaaacagtgcttgtaccaccaggacctgacagcttcaacttcttcaccagagaatctcttgcggctattgaaagacgcattgcagaagaaaaggcaaagaatcccaaaccagacaaaaaagatgacgacgaaaatggcccaaagccaaatagtgacttggaagctggaaagaaccttccatttatttatggagacattcctccagagatggtgtcagagcccctggaggacctggacccctactatatcaataagaaagtgagtgttttttatcaggcatattttgctgctaattgcctactgcattccttggactgttgtagcaccaacacatgccaaattagcacaaaatcttaagtatccttctgtttaagaaatgaaacacatttgtgggtggtttatgcatatacatgagaaatgaattgattatatcataacatatgcaactgtcccaaatgcaccatgacaaataaaaagaggccaggtgcggtggctcaagcctgtaatcccagcactttgaggggccgaggcaggcagatcacgaggttaagagattgagaccatcctggccaacatggtgaaaccccttctctgctaaaatacaaaaaatttgctgggcgtggtggcacacgcatgtagtcccagtcactcaggaggctgaggcaggggaatcccttgttgaaccctggaggccgaggttgcagtgagccgagatgacgccactacactccagcctggagacagagcaagactgtgtcaaaaaaaaaaaaaaaaaaaagaaagaagagagggtgggagggaaggaaggaaggaaggaaggaaggaaagaaagaggcagctaatttaacaaattgacagattctctccacagattcgatttactatacaatttttttgtactttctgtacttggaaatacttggaaatctcaaaatcatgagttataaagactatacaaaatattagtactaatttttcatgcaaacaaatttgatgccacaagggtttgcaatttcaatgtcatgttataaacaacaaatcaattaatttcctgaagaaattttgttacctgtaaaataacatttttacataaactagaattttacaagttatttaatattttggtattaatgtactaatattggcaagaattaacaaaaatgtcataacctgaagaacctataaacaatatttgaatgcgtgcttttttcatatccatgcttgaaatgaatcttatgttaagcatccaaccgttcattatgactgtcatttcaccaaaccaaaacaaaaagcataaaattttttttaagattattgcattgattttaaattaaatgtatgacgttaggtgattcgtaacattttcttctttatcacttgacacaatgcatttgtgaatcttagtggaaaggtagggcacaaagattgtaattaagtaaatttttttgttggacctggaccttaaaataccccctaaacttttagggactctgtttctggcccagttctgtgtgaagttagtccttgccaaatgcatgcaaaagtttggcatttgtaatatgtgaatttgaggcagttttataaatcacttccgattgacagctacagtttcggaggaaagagcgtcacaaaaggttgactagccttaggttcagatttttttttaacttttcaggatatagtcagtttaagtataacatattttcccttttttttttttctttttgagacgcagtctcgctctgtggcccagactggagtgcagtggtgccatctcggctcactgcaagccccacctctcgggttcacgccattctcctgcctcagtctccccagtagctgggactacaggcgcctgccaccacgcccggctaattttctgtaattttagtagagacggggtttcaccatgttagccaggatggactcgatctcctgacctcgtgatccaccggcctcggcctcccaaagtgctaggattacaggcgtgagccactgcgcccggccagtattttcctttttttttttttttaaacattatacaactttaatgttacaccatctacaaatctaaattacatttaaaattatcagttgacagtggtactaggatttactttaggaatcactacatatttcccctttttaaaaactgatctattcattttacagtagaggaagggatggatcattttccatgtatttcattttcctctaactttgcttttgaacaccatattgtcaaatcttagttgataagagattattaatctcataactgccatttaagttatgagaaaagttgcactttattatttaatcaactctttggaaattaatgtatctgaaaagccaaagcccaaactaaacaaactacaaggactttatttgtataagaaaagtaaaaatgcagataatccaattgcctaaacattttaattcgtttaaaatgacttcggtattgaagtgaagactgatgtgttccaggcagaaattcattcacagtatagagtatgctactgtatttatagccattggatacttttagtttattcagaggctgctcttgggatatgttagtgggctccatcctcaacaggccttttgctacccccagacaccgggtcctcacctctttggtagcaatcaccatctaaaaattattaaagccacccagcatctatcccttaatcaaacagggaagaaatttagtatctctgctcctatgctgggtccttatttgtaaaataataaatgaatgttttgagaaagaccaaactaatgcatgttgacaaaggtagacattcttcatctggaaaccagaacaaccaatcaatcttttttttctttaattaaagagctttcagactgataaaagtgattgtctcgaggggatgtccctaaacaaaatggtccataattggtttataatgaattatatatagcaaaggatataaagacagatgtaaaacaaaattgtgcaaacattttcaaaatactcaaaagaaacatcttaaaactgagggtgaaaggccaactctgatgaagtgacagccagattcttgtgtcgaggaaacccttataaactttgttaggctcacgtctaaacttgctcttaacatcttctgttcttatcttcaaatgcacatggtatgaggaaagaaaagcattttggcattttggagcaaatcacagtgtgcaagtagaacaacctgataagggaaatattgttatcaggaaagagttttccccaaggtaaggtatactcatggcttttacattgaactgacagcaagcaaatcttcaaatgtaagtcattcaacagcaatgcacacgaagctttttgcagggctgaaatccttaaaaactaacatggtgtgcttagaacacatgattgagttatgtgtttgaaatttccttcttctgcatttttatgtcttaagacttttataagttgcctgtacacttttttctgcctttaattttcttttctaattggattatttcagtattgaaaaatatccttaaatggaattaatttgctctgactaaagttggaatgcttagcaaaatctgaaccttttaaaaataatgaatatttctttcaatattcgatgactaattttactttagtgactgggttatctgagattggctgggtgatcttcattaaaacaatgcggtacacatacacagtactcttgacacagctaaatggtcaaacagtggaaatgtcaccagggaaaatgtttattaggacgagattttccactaatgctgatactgggggtgtggattagatttgcctgagtgaaatggaatatgcagttagactagtgatttccctaaagttggactctagtacaatagttaatgtgtcatttgcatcagtatacaaagactctggtttctttctcaactatatggaatagacaaaacaagccaattgtaaaaatatttgcagaatccattccttatgttatattttatgttaaagtgcagtagtgtacatgcaaggaatttatgtgaatagaaaaaacacaaccaccacactgaagctctctgtaatcttttacaaaggcagtgtcagtgagcttattaaaatgtcactgctgagagtatattttccaatggcatatgcccacatatttttatcctctttgtcccagtttaagatgtgcaaattatgtaatgttcaaatattctactaaaattgttaaagcagtttaatccatgttcagtaatattgtagtagtaactaaagaaatagtagcatctatgcatcatgaacattcctgatgcatagaagcattagaaggtttttagatcctcagatgttttaagccttcagagttccaggttaaaaactcaggggaaaaaaatgctatcataatatggtgacagtatttttcatatcatgttagctctgactcagtggtctttagaacatgattccagattggtttccctttgtttgtttatttactttagctgtgtagcaaggcacattttagcttgtgaacacacctttttttccctcacgggactttttttcacagtttcctttcatagcttgggctgattttgtaccatttggccctacattcaaattctttacccactctttattacagaaaatgtcttccttctcatgttcttgttaaaattacagacgaatcattattaccatggaagaaaatatcattttaacaatgtgacagtttactggaaatagaatgagacattttagatctgtagtaaaaatggatgtttgttaattatggagtgcagaaatgcattcatttttaaaaagtcctatggatcatttaaaagtaacttattctctcttgctatcaactgtcctgaaaagatgcacactccctttttcttgggctccatgagaagtcatatatgaatttgtgatttcaaattcatgtttggtctatcactgccaaaggagtttttagttgttaaattgggtggagagagtttgttttgtttttaattggaattatggagtttttcttgcaaaagtaattaacgggaaatcagaaaagaggatgattattaaaagcttataatttcacgaattgtcatatgggcagtccccagtgtgtagctgttctttgcttatcatcagctcctgtaaaactaaaagtcacccagactctcccttacatccaggaccctgtagttgacttcccaatctttctcttccctatgcactatttcttccttgtgcttctttttcctttgtcacctccctgtctctgtctcagaaacagtcccaagatggtgatgttgatcaataaaatgatgcttggcatttttagagtatctgccatatctataggagatccttcaactgaaagtttccaaaacccaacagaaacaacttttggggaaaaataaaggaaatgtgtctagtgaatctggttttaatatcaaaatacccagtacctcaaacaatgtcatgagggtactccttttccatggtcagctctgctgtcacccatgctggcttcatttgcaggctggctcttccacaagatggcagaaatagccaccagtggtgctaaactaacatcctacagccttgtaactactatcttctgctaaaacaagaaagaagaaagaaaaaaggcccaggtttccttcaaaagctctagcagttgtcctagaattgagtctaattaggtcacatggcctcctctgaaccactcactttggctagtggtatgtgatggtctccttggtatgggatggtctctgtcatatactaacctgtgttgccaaggggtgggtcagctccaccaagccacatgggaagacagtggggcagagatttactccaaaaggaagagaagaggaactgttagaaaaggtgtcctaagcaggcaaaaaaaaaaaaaaaagctatgtactctacatgctatatataatatcagtataattactgttcttttttaatccacagattctttcaagatagctcttgtctttatttaaaaataataaaactgagtttaaataacttgcctaagactagttttaaaactagaccagtgagtttccatggcccattgccatgttagtttggatttgcagtcatagcactaatcacagcagtggaaaaaaaaaaaagagaagtcagtgatggaatctaaataagcctatagctgtccttcctgtttcctactcatgccattttgcaagatgtgattctggtctcccaggccggcagtatttcccgaacccttactggtcatttcaacacttggccatttcctgcctttgtaaaaccttatttatttattattattattcatttttatcaacatcaccatcttgggactgtttctgagacagagacagggaggtgacaaaggaaaaactaaaatcttagacactcagtgatctagattagcttctaaaataattagaaattttttttcccactaaattccagtagggtgataagcacctattttcaaagaggatcaattcaggaaatttaaattgtgtgcctctataaggaaatggcatttaaattgggatctgaaggttaaaaaggaggagggagaggagaatcttccaaggaaagagaacagcatagaataagacatataatcaagctgacctgtaataggtaagaagagaataaggtgaggttggggaggtagacctggggctagataaaggggatctttcagtacatcttaaagagtttgaaggttatcttcaaagcaaaatgaattcccaacaagtatttaggtacagcagtaacatggtccactttacattgttaaaaatcactcaacttctctatggagaaatttaggagttttatacttgatctagcattttgacaatggagatggagaataatggatagagtcagaattggttttggaggtgtttaggtgtcagacagaaggaagctgatggcctcattttcttagataggaagtttgagaagaaagatactgaacctgaaaattccaatactaaaattggccatgctttggagaaacagaaatgttcttatatgtgtatatttaagagttagaatacagagacgcattttaaatattttaatccttatatttttattgacactttagaattcactaagggcattgacatgttttatttcactttatcctcaaaataatcctaagattggtattagtataatcttctccattgagatggagaaattgaggggaatagtttgctcatagttctcacacagcaagcttgtaatcaagctgggctcaaaagtgttctttccagtcaaagaaaaattaactgaccatataatagtgtagcagacccatggtatgtacattctgatgatatagggctgaaaaatgtttcagctccagattttattctttttccttgttgttataatttcttctctctgctggagaagaggttgagggctctgcagccttggctgacaaaagcctacctaggcactttctagggaggcaccttctgcagagttatctcctccactggccccaaccctccacccagctaaagcataggaacaagcaattttacagactcttctctaggtacaaattcttctcttttgtgtgagcatatggcaacaatgtttaaaaactgactgtgaggcatggagtccacagacatgttttgttaaactaacaaaattatttataattttgaattattttctggcatttataaatcagaaaatctttcacacactcataaaattatacatctaaggattcctcttgaaatatgagttcaggcatcactgacttatatgcctaaaactggcaggtacctattgtcacttagcctctgtgggcattttagtttgtaatctgtggcttaaggaccacatctgtcattaagtgaaggctatatattaaagcttggtggcccacgggtaggcaagtgacacagattgttgtttagtctggttatcactggttggaaggaaaaaattgaatgagactaggagatgaaaaaatattaaatatggcatactctcttcagagtcaggtagaaagcctgcaagaaaacttttcatcccccagtgagccagaaaaggaagaaaagcttggcttgaactcacaggctatgacaaatgagaagggaagtaggtgagaccatttaaagtccttggggaaaaaatattatataccatggaattgacccagcataagaaatgtccccagagatatgtattatactaatggaatctcctgaccatctatgctgctcttcacacccaaaactttgaagcatctctcctcttgcaacatggctctaattctcccccttcatgctggaacctctttccaagccagcagcttagagctatgaaaaacttaatagcacttctgggtaggagctagagccagataattttcctggtctgacttccaggctatttcaaggacagaactctgccattttcagagtaacactttcttacacatagtgataaagtttctcagtgccattcattcagaattgtacttcattaacagtttgatagacctgtgggtctagaaatatatgtgtatctgtgagaatatatgttcacatttccaaacaattgacttccaaatgcatttctggagcacagctcatgtacaagttggaaattgcctgtttcaaactttgaagctaaaggataaatttaaccaaccagtagtatattctacattttgtgtattgttcatcatcatagctcaccttcctgtgttatttcttgtttttgccagtagatttactttaagagtaggaaagtgcaataaatttggagtcagtcctgttatttggcaatgtttcaataatgtttagatgaaacacaaagttacagcttatgtttaaactatgtactttgaagaatatggcccctagattgaaataaatgttaaggtaatggctatatttaaatgagaaaaagaaactggaaaaccatggcttgttaaattcaatgtccatcctgggaaaaaattgtaaacaaatcactttctataagcccagaaacaagaaaagattactagataataacaaatatagcttcataaatagcaatttctaccaaatcattataacataattattttcttagtaactattcagttagatcaaggggcaagatttcaatccacatgtacaacataatcattgataatttggccaatggtttgtgattttttacaaccattaggtaacaaacatattaacagccctgctatgacagaatcatctggattacttatttaaagtataaaaactaggtatcaaaatctgaccagctaaattggaatcacattacctctatgagctaagtacatttattctgttttcaagtgagataactgagtcacagaaagttaagaaacctgttccggatcacactgctggaaggcagcaaagttagcttttgaatcagaaatctaatttcagagtttgcacccttaacataagataaaacaaatcatacttatattttcataatgttgcttcccagattattaaactgttaattaccagggttattaccaatttttctatataacttccttcttgctttttctttaaaaccagaaatgatttttacatggcaaggattgctgaagaaggtatgagcttgctgaacaatggatggtttaagtttaggtctgtgctgcccaatatagcagagattaattagccttgtgtagctattgagtatttgaaatatgtaagtgtaactccatatttcaaagatctaagacttagtataaaaatatacatatctcaaaaattttttatatcaatttcattcccaaatgataataattcagatatgttgggttaaagaaaatactgttaaaattaatttcacctgctttgtttttcttttaatgtggctctcaggaaatttaaaatcataactgtagctcagatttgtagcttacattatatttctgttggaaagtgctggtcaaggtaaccttcatcaattcttctatattctattaaaacaaatagttgagcatctcctagtttataaatgtcttggtgtcataacctatgtatctttgttttctctttagaatgtagcacagggcattgcaaatattgtactaaacagttaatacatgtattctgaattgccatcaattgaaattaacaattggacctaaactaggtccctgctcatacataattaccaacttattgtatatatgcccaataaacttggtacctgtatatgaagacataagtgacaagctagaacaaccctattgtatgaatgttacattcctgcaaataagtctgtaaagtgatttttcatatataaaatctagttgttacctcagttacaatgccatgcttcaacatttgttttgaagcagaaaattatccacgtgttaaaatgatgttattaatttcaaacagttctatttctttgtagaactgcaattaaagcatttgttttggcactaaaatgaactgaaggacaaatattaagaatagtcatagatgtgcctgaattgtactaaaccacaaagtcttgctgcttgtaagtggagccagtcatgtcaatgttcctatgagccttgggtggtaaaaaggggtttgttttgggctagatactactgtataaaccttttctcctccaccaccaactttgaactgtttcttttttattcaaatgacttaatgcaataaaagttatcctgataagttgtattaatgaaatctttgttgaactaattagatttaaaggatgctaagatacttcactataataagctaaccaatacattcttttaaaaagtttttaaaaagtcacccaatttaatagttcataaatcttgattagcttaaagctacacaatatttgtttatacagtttaaggtacagcaatatcttagctagtctttgaactcttccctcttggagccctttcttatacgtatagcggggaaggcaaatatttatatatttgaaaactctagagctacttaagtatttgttgtaagcaaacagtatttccttcagactcttccctcccttcaatatcatcaatgccacttttgggagaaagctgtatctgagagtccttggaaacaagtatccttttattaattcttaacacttataaactgaatgatcggcttcttggctatgtaagcaattacaaggaggtaagatacagacagttgaggaaataaacaaacataagatcaattacatataataagactgacattctaaatggaacttactctgacatgaaagtgctatcatatttaaaattatacatattgggttgctatacaagtctgggtactgttgctttattggaaggctgtttaaaatccatcaataccttaaagctacatctatgaagtttgtacataagcatgtatgtttcaatctgagaaaaatggagttctcacagaagaaatcctatgaaaaaatggtcctttaatgttggccttattgttagcttcctgggtagcaaggatgtcttgcacaacagtatgtcttatgaaaaattaaagcaaaacaaataccgttgttcagtaaaaaccttaccaattccatttataaattcaacttgcaagtattttccattgcacatataaatcttgttaccaaataatcttctacacattctttaaatttttaaaatgaataaagggaatacactgtaaaatcagtaaatgttttcatctaaggcttgaacaattgataattatgcccatttgtttttaacttttgtgtcaaagtattaattttctctatgtcaaaggacttttagatttagaatcacataccaacattgagagtgctttggtttcattaaactcatcttacttagtttcagccctttatacctccttttatcttattttttaaattgacacgtaataattgtacatatttatgaagcatatagtggttttaatacatatgatgtatagtgatcagatcagaataattagcatatccgtcatctcaaacatttatcattttttgtgttgggaacattcaatatcttccttccagctatttgaaactatataataaattatttttaactgtagtcatcctacagtggtgtggagagctagaatgtgttcctcctatctagttgtaattttgtgtcctttaacagatttctctctgtccccacctttccccgatttttgtctagaatcctctgctctttttacttctaggcagacttcctttttggaaccttttgtgtttggtttctgaatcttgcctcttttactttttagtactcagggcagaaatatttcccctcccttcttttagatctctagctttgccttttactttaccactccttgtctgtcttttctgttttggtcatttattacctctggtcatggtttgggctgaacagtggccaaggagccagcatcacaggtgttctcttctaagtatggtcctgtctccttaggatgagcctggttattttccttatccacggaggtacaaacagtaccatcttgattatcctcacactccagcccatgatttaggccatctatggattgtcatttctttctcattatctctttgtatcactactatttgtttcaaaattagcttttaatattatctgaaatcaagagattcttattttaaaatatatatattctgtgttatatttttactggttctcctacctgtgcccctaatatttctttttctttttttcagatggagttttgctctcatcacccaggctggagtgcagtggcgcgatcttggctcactgcaacctccgcctcctgggttcaagcgattctcctgttctcctgcctcagcctcccaagcaactgggattacagggacccaccaccaggcccagctaatttttttgtgtgtttttagtagagatggggtttcaccatgttggccaggctggtctcaaacttctgacctcaggtgatgtgcccactttggcctcccaaagtgctgggattacagacgtgagccactgcgactggccatctgagcccctaatatttctttcagattttactcagcatatctggggggaaaggaagtatatgcagtacatttgaaaggtggaccatatttattcctgagctagctcactttgggcctttctgtgtcgttacatgctcatattcccccacagcaaaggcatttgcattgcacaagtctgttcagatttacgatgatctcacaatgtcattcagggacagaatccctcaatgaatcagagaaaaagagggctaagtattgttggcataggggattgttcttctagtaagcacaggtgaaattctcccttccttcaaatgcgctttgtggtaaagctctatctgttttctggactcatactccttcaaagatgatagagggaatgcaggcagaggtgagacttggagcagtgcttctcaaactctgttgaggatgtgaggtctctattcttctataaaatgaagtaaaaattagtttctagaaaactgaaatgaaaaacaggcccacaacaacatccccctacttttttattattagaatagacagacacaacattaattggccaaattgccttacaaatttctaaacatggactctccatatctatacttaaccagtactggttgggggaccatactttcacagccagtttaggacacttctacccataccagatagaaagtgcttaattttcaaaaaccaactccattagcaggtaggggtgtgggagggtgggtttgctttacttgaatttagaaaatcctgcaagtataggggaaatctgttaatgagctaagactatacaaagattcttagtagaaaataaacataacatttatgcttgctgtatcataacatgatctgtgcagatatgcatcctaaggcttagaaaagaaagctttcgaagaatgggtgaatttaaaatcaagaagcttaaaatttccttccccaaatatgctcttcacagagataaaggctttctccctggctctgtctaaatataagtaagcaccttggaaaacattgagtcagagccctttttatacccttacatgttgcttctttaatgttttgtctgcccactgccaattgatctcaaataagtctaatttttggaaggaatttcattcacattcatggatcctggattcttcaggagcttggagcttctcctctgtgataagaaagcactgcataagataggaagtcaattgggattagaattcaatatgtcagctaactcagaaatcccagtacagaatttagcactcctggtcaacgggtactctccagggatcttggcctccagaaatcaattattggattacatccatctaacccaagagtgggtttgatggtggctgtttttattttctattacgaagagagtgataatgtttattttatgaggatagatggtaaaaacaatctttatttcaaaaatagtatcagttctgttgaatgattttgcgttccacaggattaattttcaagatatttgaattgggaaagctgaaatgactataaaaagcatgtagtgccttaagttttttggaatgaaatgaaatgtgcacccatttaagactttcatttaactcagacacttaaaatatcgagaaaataaatgacttctcttggctaattgtcttatgtacaataaaattgagggtaagtattaggtaaaaggtaagtggtatcattggatttcctctctaattaagaagagatccagtgacagtttgttttcatggggcactttagaaattgtgattgtgctggtttctcatttaactttacaataatttattatgacaagtaacagaaagtagataacagagtttaagtggtttatactttcatacttctatgttgtgttcctgtcttacagacttttatagtattgaataaagggaaggccatcttccggttcagtgccacctctgccctgtacattttaactcccttcaatcctcttaggaaaatagctattaagattttggtacattcatatcctttttcaagtgattaatattaactatttgtacatgatctgtaagcactttatagctaaatatcaaattaagttgggaaatgtccatattatatagttttcatcactctcattttgcatctttgtcatattagcctcattcttaaagttcattaatcacatagacattactgaaacatgtactctttaacattttatatattatatataaacatgtatttatgtacttttgttatctttctaaaaacacttatatgtattgaatcctacaaatctaaagtaagataaccatgtttacctctaccatctttatacaaagtttgtgatggtgtagaattttcagtgagcaatgatatgataacagaaaaatctacttccagactcaagtttatccatagttatgatataaaacacttcagtgtatcttagaataaacctttaagtatattttctgtcagagaatgtcaggagtctttggccagtacttagttaattcttgaaatttcctgatgatttttgtgaaggaagtactggaatattggctgaatttcaaattcaagtcatgagttatgatgctgccatgcaaaactgtttgcttagtaaagactccggaagttaatgagagaagttggcatatatttccaaatggtcttaagggatttggtttcatgattcccattggtgttaaaaaggactccacgactaaattcatttgttaatcaatttaggaaaacaattcacttctgattgtatcttgtttgatagctttgacaataatagatattaaaataccattataattatcataagctcatacttttttttaaaggattctaaaatttgaacggccattctaattttaatatgacagcaagaaatttctttagtggtataaatatgctattactaaaattaaaagatttgaaacataaaaatcatatgatagggtttttatacttagggaagtttccttgtcccagtttgtattcctagcgccatcatgtggtcatttgatgaaaactttctttttcaattatggaaaatttttgttttggcagtaaactatagtggaaagaatattggatcttaatgtaggaaacttatattctagtcctggaccctttatctgattcctctagagcttagtaaggccttatttccctgatttttaaaatatagtgataaactaatttttagggtccctttcagttttataattctgttatgtctgttcatttgttttagctaccacttagagtatatttacttacgtaccgtgactgttccaagcatttccaatacattaactcatttaatctgcatgtagaaatggttacattacaaaatgagtacattattagctccattgtagagaagtaggaagagatacaaggcaatggcacagagaggttgagtctcttggccaacatcactttgctatgttgaattttaattacattcccatcatgttaagtgtcaaccttcaagaatattcacttttaatgttatcgaatcctgctgcacttgtataaactcagtcaaaatagagcaacccaacaattagcatcgtgctgtactttgactacaaattgttttcatgcgttgaactgtgttggataagatgtgtttaagaaattacaatattgcagataagtggccttcctcaacaatttactagtttattcacctgaatgagctcaagtcaatactttctgctgaaaaactgtgcaactccaggtagcacaaaaatagtcttcccactgaagttctctgggaggtgaatatattgatttaataatagttgtaaaaacaacaccttatactgatataatgctttcatatacattacctcatttaatctatacaaatactcagtgaaggtgatattattacccacattttacacatgaagaaattgaaatgtaaggagattagaagacttgcccacaatgcatttatccctgaattttggctaagctgcagtttgggcttttcaatgttagctttttgtaatataacacttggattttgattttcttttgtgtgttccttaacaataacctacattattcagcatgctaattatgtgcactattttgacaaactgtgtgtttatgacaatgagtaaccctcctgattggacaaagaatgtagagtaagttcaacttatatttttaataacatatatacatttgggattttgaaactgtgtcttaatgtagtcttaaaataaaactgaagagcattttattaaagtcattcctagacaaaattacgcagcaagaggacaatgctcattggccctcaggcctgctggcgttatactgattatcactctcttttgcctgtacctggtgttcacctgaagaccaccactcttggacatttacccctttttctttaaaatctacagtagccaaaccaaatgtggtcaaagcaattgcagaaaagagccaatatggtagacattggttccagttaaattccagataaatacattgaatcaagaatcaaaaagggttagttacaaatgccatgtgaagacaacattgaacctcgcaaagttttcatttccatcaggcacattcacttcatgtcaggccaatatagttccaagcgtggtcaccaacaaattgaaaaataatccaaagtttcagggttgtagaacttgaaaattcagtagactgaagactaaactaacagaagtggaactttttgtagagctttcagaaaccagaagcattactaactatattgatgatctctctgttctggggataccttcgaagcacagaggccagatttgtgataactgaagttgggctactctaaccatagctgctcacctgcccacacttcctatttgtaatgcctgttactatacagctgctgacccatagcaactacagaagtattaggttggtgtaaacataattgtggtttttgccattaccttcaattgaagctaatgtttgcaccaacctatttccaagagtgtccaccaacatttgcaccaacctatttccaagagtgtctcctttcctagacacttccaggctgaaaccaataagaaacatgacatcttgaagaaaataataaattttatatacaaaaaaattctaaagtattgaagctaatatgggaggccccacaggttttcagtcgccctagttttcttgtgattttatgccactctcacaccccaatttctgagtagaagatttaaactttggaaacacctaagtttctgaattatcagaagaattttattctaaattaaatttttacttcttataaccctagaagtatttactttgattttaaagaagtccttgttccaagcaagttaaattatcttgtagaaaaaaaaaaacacgtgctaatttgtcagtttcctctcattcttagaacactattaaacttgagatttttttccctaaaagaaaatcatttcatgcttctgcaatattattgattggctattccatcatgtaaacatactaaatatttctcaggagactatatttacataaataccaagacatttcagacaatggctaaatagatttcatataccttgtatttctcacactactcttaagacactttacgaaacaactctttgtgttaggaagctgaatttaaatttagggctacgtttcatttgtatgaaattaaaatccatctgcttagttttcttttttagtatttatctattccactgatggagtgataagaaattggtatgctatgaaaaaacactgttactttatcaaattttttggatgcttgttttcagatacaccttcacaggaatatatacttttgaatcacttataaaaattattgcaaggggattctgtttagaagattttactttccttcgggatccatggaactggctcgatttcactgtcattacatttgcgtaagtgccttttttgaaactttaagagagaacatagtttggttttccatcagtgcttatgcttttaagaataggtttgctttacctgtagaatattttggtgtgatttatacattcaaactctggatttcaatttagcacaacaaaggtctaagtggaatttcactatagcatgaaggctttgcagtagttgaaaactacaattttcacacgtagcatcagtcagaaaatttcacatatgccactcttccacacacacatgcacaaacacacacacatatgaacacacacaatctaatgtcaaaacacaagcatatttgtaatacatctgtgaaaataactttaaaaattacagccacaaaacagttctattggctacacaaatttgcaatgaccttgctgatattacacacagcttcttttattggtttggtaaaataattgaaagtaagtatctactagcatcaaaacgatctgacaaatcaaactaagagaagaaagaagatacttgaaatattatgtttttaatatattaaattactgatttctaagacctgtagaggaatacattctctctgcctctttctgtttctctcctgaccccttttctttcttcttttcttctttccttttatggctctcttcatctctttagtctgaacataaacttccttatccttatctcctattcatatccactcagtaatatgcacagtttatgcaccccaatgcttttttttctagtggcaaacttcctcaggaagagacccagaaaaataatagaaaaccattccagactaagtgaaagtagagtgtagaaggaggcagcccaacaacacttaccctcatccttccttcaggagctgattttttggcctctaacagttgtgatgtagtggataggagcaggagaggtggcactgatacactcaggactccgaatgtctggtcttaatttcctatctgatcaggatgagccaattctttgctaggctctctggtcacagctcaaaagaaggcctacaggacttctatttcttaagaacaaaatggcagtaacaataggcgcagcattggaccctcatcaagtattgttcttaatttgcttaacttttatttaaaagttacactaggaaaatcttatctcatatataaaagcagtaaggcaaactgccttttcatgcctaaatttctgttgggtgatttcatatatttttttctaactaaaaccctaaaccatagccaagatttactttctttttacaagttacacatgatgttggttgcattgctttccagagtgacaacaagggtgtctactttatgaagtttacatttagctaatggccttaaattatgtgaacaaagattaatgatggaatctaattcctgatttaccacttataatatttatcatttaaaatcaccaagaaggtctttataaaagacccatgcaagtaatataaatcctgctaaaatcttgaataattctgatttaattctacaggtttgtaacagaatttgtaaacctaggcaatttttcagctcttcgcactttcagagtcttgagagctttgaaaactatttcggtaattccaggtaagaagtgattagagtaaaggataggctctttgtacctacagctttttctttgtgtcctgtttttgtgtttgtgtgtgaactccctattacaggtacgtcacagagtttgtggacctgggcaatgtctcggcattgagaacattcagagttctccgagcattgaagacgatttcagtcattccaggtgagagcaaggttagataatgagacggacccatcatgtgattcagcatccttctctgcttgacattcagttttacagaaaatcaggaatcataagactaggtgtttcaaagaaaatgattcttattgtttagacataagctttatcagccttggagtttaacaatgtcttatgtgagatactgtaatttgaggtcaaggtgacctgcacttacaaatatcatgggtttttttttttttcaccatgttagttttatcgagaatttgctcccttttaaatgtaccaatctgtaatttcttattcattagagtcattaatgactatgtgtatacaatgcaaatcttctaagttttttgctaacaaaagagaagggaataagacaataaagaatagtgtgagtctgcatggaggatttattatcttaaggcacaattatactgcagaccattttcggttgtacagcaaaatctttcctacttataaataggaattttaaaatatttattcaggtattttgttataaaactgacctctgaccctaatgaaaatatgagacaagtttcagtagcaaaaaggaaaaagacaaggccctttccttaatataggctccatgaagaacatgaaccttccattactctatctcgacataatgggatatgaatcttcatttcattgtttaaatcattacatttctggagtttatcttcataagttcttccccttcaatgaagtgttgcttctccactagcgttgcaaacattcttggatttatgaatgaaatctatgttttcaagaaaattgtgtgaagcttttattatttcacacgtgttaagtcttcatagtaatagacttctttctttcaggcctgaaaaccattgtgggagccctgatccagtctgtgaagaagctctcagatgtaatgatcctgactgtgttctgtctgagcgtatttgctctaattgggctgcagctgttcatgggcaacctgaggaataaatgtatacaatggcctcccaccaatgcttccttggaggaacatagtatagaaaagaatataactgtgaattataatggtacacttataaatgaaactgtctttgagtttgactggaagtcatatattcaagattcaagtaagaattattgttatgtacatttccttaaaaagtagaattggattgtttgtaacacaaaggataaatacttgaggggctggatatcccattttacatgatgtgattagcacacattgcaggcctgtatcaaaacatctcatgtaccccatatatagaaacacctaccatgtacccacaaaaattaaaatttaaaatttaaaactaatgaaataaataaaacaccctctaaaaaagaattactatcatgtatatttggtcttttcattgctaatgtgccttccatctaggaatgaaaaatatttttaaatgattacataacaagacgtgatcttttagaaaattacctaatcaaactatttaacaatatttaaaattatattttatttggtatttctaccccctggattttaaataatagattatttatatttctggaactaaaagaagaattttgttaatcaccttatcaatggcttccacatacatttaacaactttgttcataactactctagttttgactcctaaatgccactttctattttatcatcatttggaaggctgaagaattcagctagaaagaattttcctaggatccttggttgctatacattcttcctgtggtgattgatataatgaaaggagataaaatatgtgaatgccctttgcgaattctacaatactatgcaaatgtaactcattatacattaattacacaatgtctttaatgtatcagaaactgtatagtacactggggaaaataatggaggtaatgcatggcttcagagtgttatagtttaatagattattttattaccttaaggaaataaagtgatacctaaaagtaaatcttattcttatatttaaaaagtagtattacattaaaaagaagaaaattacagttaataaagcttcaggagacagtaatagaaaatgttagttgggtgcagtggctcacacctataatcctagcactttgggaggctgaggctggaggatcacttgaggccaggagtttgagaccagtgtgggcaacatagtgagaccccttctctacaaaaaaaaaatatatacacacatatatatatatatatatatatatactttttttaatgagttgggtgtggtggcatcttcccatctcagcctccttagtagctggtgatacgaatgccagtaggtccacttcaatcaccagctccctgaaatctgttgtttgtttgttttatctaagttcaaaatactgactatgagggttatttagggtttattctctctagggaaaatttattggactgcatttttccaatactcgaagtaaaataatatctgaggtcattttcagctctaaacatctatggttcttattttaaaccaaatgcaaatataaataaaatggttcatttctgaaaataatagaaaattaaatttattaaaattaaaggtaactattataactgaaaaattatattttcctcaggttaaggctgatcattaaggttagatcattgaatttaatgggcaaaacttcatttataaatatgagatatcaaaaattcatccagaaactattatagtcctttctctttgtttaattttaattgaaagttaggaaatactatgtcaactttcctgtctaggttcaaggaagtcagaatattagaaataaaaatgatatttttccttatgtgcttctgtgtcctgtacagaactatgtatggaataaattcctcagaaaacttagcatctagaaaatatatcttcttacaaaatccaacattgattgtttaattccatgtttttctctttttgtcttttatttacttattcattcaataaactttacagaaaggctacccggtctcaaacaaacactaatatagaaataattaatgattgggactttctaggaggaatatttgtaaataaataattacaatatagtagtgtcatcctaagaataattcaagtatatacaggttactggtagcacagtgaggggagttcttaattatgtcaatatttagtagaaagaaagttgaaaataccaaggaaaaagttatagaagaactggacattgcaagaagccaaggagtttgcaagaaacaggaatctttgagataatgtagtgttcacctatagtcattattttagctttagtatttaagactttttaaaattgctttcatttcagttgttgatatgatttatgcatattttactataagttgcctatattctgcaaaatgtgagaatatgttatacttaattattaaaatgtatagtgttaaaaatataggcgagaggaccagaaaatatactattcttttattttgaaatatgtggctgttttgcaaaaacaaagaaattcctgtcattcctgtctatttttactgaatgaatttttttcgtgagaatggtgaacaaatgctaatacctttttgaaagattatgttagtacctgtcattatcactaactttacattcataatgaagaaatactttgcactgtaaagtgtctaaagtatctttgcactgtatctaatctaatgtcatttcttcataatgaagaaatactttgcactgtaaagtatctaatagaatatctagaatttagagggagaagagacaaatacttgtgcctttgaatgaataatatatttaaaattactcaataaacttaaaagtagaacctgaccttcctgttctcatttgagtgtttttaacaatgcaaatgttcatcatacgactttcttttttcaaacaggatatcattatttcctggagggttttttagatgcactactatgtggaaatagctctgatgcagggtaagtcaataatttgtgtgtatctgtgtatatttgtatgtacacatacatatgtgtatcttttctctctttttatagaaactgaagataacagccaactaattttattgacattaatttgctatatgtaaggtttttgataaagtatgagattatgtaaatattaggtaagatttatgttttctaaaacaagaagtaatacttttagacacatgcacacgtatgttcattgcagcactattcacaatagcaaagacatggaatcaacctaaatgtccatcaatgataggctggataaagaaaatgtggtacatatacatcatgggatactatgcagccataaaaaataactagatcatgtcctttgcagggatatggatagaactggaggctattatccttagcaaactattgcaggaacagaaaactaagtaccgcatgtcctcacttataagtgggagctaaatgatgagaacacatggacacatatagggaacaacacacactagggcctaccagagtgtgcaaggtgggaagagggagaggatcaggaaaaataactagtgggtactaggcttaatacctcagtgatgaaataatctacacaacaaaccctcatgacacacatttacctatataacaaacctgtacatgtacgtacccctgaacttcaaataaaagtataaaaaaagagaaaaatatctattaaacacctactgtatataacagcaaacatacaaaaagaggagtaatcctgttcctacttttttaggagtatataataataacaatgttgttcttttagataagtatattgagctataaactctggagactccatagtagtaaaaatgaaatggaggtgttgaaaatgcaaattatcaacaaaaattattttgtaaaatattattagaaatgctgcaccatattttaatgatgacaccaagtagctaataagactatatgcagtcaaaagttgggaaatagattagttacttatttgtcaaacttttattttgaaataccaaatctttctgactaggcaatatcatagcatagtatcagagtaaaaaggcagcagaacgacttgtaatactttcttttaccccacttgcagccaatgtccagagggatatatgtgtgtgaaagctggtagaaatcccaattatggctacacaagctttgataccttcagttgggcttttttgtccttgtttcgactaatgactcaggacttctgggaaaatctttatcaactggtgagaactaaagagccacactctccatttaagtaaaagtatacaagaaaaccaattgagttatgaaattaaaaccggatgataatatagtagaaagagcagaacttgaaacgagacttgagttcctctatcctattgattataacacatactgagcagagtgatgccaaggattgcaattctctcccatttcttcttggctcaaaacctgttccctacccttctcagacacagattgtcctaaacagaaggcacattctcccttcagccctatctaccccctcaaatattatccctcaggtgggaagtaatgaaaatgaaaaagcagatatagaaagataactttggtctgttccttgactttcctaaaggctcaggtcgttaatggaggactccatggcattttattgactgtttcattcttggtgaatacaaaaattctgccatagaaatcatagtgtgaatgcataagctagaagagaaggaagaagctgaagttaaagaaacaataaaaaaaaagtacagggtgctatgaccaacataattactatttatatctgagttttgctagacacatgagtaaattgaaagttgaagccaccacttagtgaaataatattgagaaataattctgatatttttgtttgcagacattacgtgctgctgggaaaacgtacatgatattttttgtattggtcattttcttgggctcattctacctaataaatttgatcctggctgtggtggccatggcctacgaggaacagaatcaggccaccttggaagaagcagaacagaaagaggccgaatttcagcagatgattgaacagcttaaaaagcaacaggaggcagctcaggtaaagctgccctgtctcatggcactgaccttttatcgttctgattgttacgtaatattgaagagaaagtgagtacctaagagcaggtggttgtatgaggaattaataatgatttctatattttgatgatccacttacttttatttagtttaattattttatttgagatgtgtataataataaccacaatagaactctctcatgctattttaatcatcttaagattctcaaagtaaagggaaaatgttattttggggtattttcaagtgagagacttttattcaatgagtagactggcattaggaggaaatcatcttttcttagaacaagaaattattggttatcatatgaagagttgctcctctagttcttaaacatagtctccttttttctttaactaaaaatatgttggcttttaacgtggttgctttattacctttataaggaagtgatcaaataatataatgatctctgatacagcagcatccaatagacatatgaatgttaccaatcttacacagattgaccatctaaaaaggattacttgtttttatagtgaagtgttagtcctcacagtgtgataaatcataaaatgcctctcctatctctctcatctttctgtttagcatacaaacttattgtctttactaaagaagaaagttgtttcagaaatattaatttatatgcaagagtaattaatttatcgaggttaccctgggaacaatgataataataaaaaagtgtcaacttagtaccagtacaagctataatcaaaaagcattgttttattccatgcccatgtgccccttaagaaccagtactgatttgaagatggtggggacagtttttggagaactggatgtcttatcttgctcagcagaaactattgattctcccttccccattcttctggatattgtggatgggtgagaaagggattttataactgtccataaataggattaataatattttgagggtattggacaatccaatttcaataactagagaaaggacctcaggtccttatcccattcccctgccttaaactcatcagcttttcttccatactcgagtttctttttcggagaaaagaaaacaacactaattaaataccaatttttaaagtaaatcaaatcccaaaaagtaatgaatttattttcttgttgatacatgttggatatttttgaatacgtggtctgtggagcattaacagagacataataaatgttaccatggagcaaactaaattatctccaaaagccttcattaggtagaaagaaaaaaaaaatctcctcttatacttgcagagaatcttctctgtgagatgatcttcagtcagttcaatatattttttaaaagccatgcaaatacttcagccctttcaaagaaagatacagtctcttcaggtgctatgttaaaatcatttctcttcaatatagcaggcagcaacggcaactgcctcagaacattccagagagcccagtgcagcaggcaggctctcagacagctcatctgaagcctctaagttgagttccaagagtgctaaggaaagaagaaatcggaggaagaaaagaaaacagaaagagcagtctggtggggaagagaaagatgaggatgaattccaaaaatctgaatctgaggacagcatcaggaggaaaggttttcgcttctccattgaagggaaccgattgacatatgaaaagaggtactcctccccacaccaggtatggcactgctgagtttactgatgcatggttgaaaattaaaacatgggagagagggggagaattagaaaatggactcaggaatttttatcaactgaatcaaccactgttgtgttatatttaaacccatcccttcttcacatagttatgcaaaaactttactccacagatatgtaagtctacagctcggtgtagttaagataacaccaagttgacagtcaggagaactggactgtcattctgatactgtctgctgatatttgtctataactaatgacatttaatctttttgatcctcagcacttttaagaaaaaaaaaaatgtggaactccggatagtcgatcaggaatgtccttaggttattttatgattttatgttttttttccccctaacttctttataagtcaccatgcatgcttctgaaaatattagtcatggtacacttgatcaaaaggcacatgactctgaatttcagaagtatgaacttcaagttccaacaatacaatgccttataggtgaaaaagaaataataattaaagtgattttagaaaggtggactaaagtaaattgtgaggagtgttgaaagtttttgaaagacaagatccataaaaaccaaggtggccttgttaaggtcatggtgccagtgttcactgaatgtttaccacgtccattgccatattctaaggatgtttccctttgaacttgagaaatggtcgttcagggtgtgtgtgtatgtgtgtgtgtgtgtgtttcaatatgttaaggttgcaatctatctcctcattctttaatcccaagggctagaaactttcttttatcaaggtaatttaatttaatgtgaatgcacataaaatgagaatgataatcaaaaggaatgaaccatattctgttatgaatgctgaaatctccttctacataatcttgcaaaatgaaatcacattcaaatgtccatattaatatgactttatttgtttgctctttcaaacttctagtctttgttgagcatccgtggctccctattttcaccaaggcgaaatagcagaacaagccttttcagctttagagggcgagcaaaggatgtgggatctgagaacgacttcgcagatgatgagcacagcacctttgaggataacgagagccgtagagattccttgtttgtgccccgacgacacggagagagacgcaacagcaacctgagtcagaccagtaggtcatcccggatgctggcagtgtttccagcgaatgggaagatgcacagcactgtggattgcaatggtgtggtttccttggttggtggaccttcagttcctacatcgcctgttggacagcttctgccagaggtgataatagataagccagctactgatgacaatgtaaggaagttttaaatagttcaggcatggctggctcactattgctgcaccagccagtgtttctacagaacggcaaccttgagaatgattcctggttggtcacgctgtgaatgcacctgcatcttgtaatatctttaatagactaaccaactaaaacttaaaaccttagcagtctcctgcacaaacctgaatgcatttacttattaaaagtgctaaggattgattagacacaataattactgcctccagttggaggatttgctatatacccacactgaatttagatagcaggacattctccaaggctctggtatgaaagtaaatgaatgattctatgtttaagtgtcaagggtatgtaataaatctttccaatggattcttcaagatctctgctttagtttagattttcaaaaacactgcttaagtagatagcttcattgttaccttaatactcctagtactcatatttttcttactaaaaaatgctgatataggtcttctcaaaattaaatgaagagacacaaatacattattaatacagacagataaaataattgtctgtgtacaaaggtatgttatgtgtttgtggatgtatactcagatgaggaatttctaaacagatgctgcctcttcttagactgtttactcacttggaaatatatcagcatgaggaggcatgactaagtcagaattagatgacttattgctttggtaccctggatgaaactgttgtccatgcagcatgtgtgtgttctttttaacatagagtttgtgttgtcaatgaccatctacatcttgtgtccagaaaataagatggcagctaagtgtgttgcaatcatttatacttccttaaaattaaatagctaccttctcaaaaatcaagtgccttgatcacttgtaggacttttaagttactaggcttttactattagttcagaaataagggtaataactgttaaatatatctcttaagagttttatcaactatattaaaattattttgtattttataaaattatgaaatcaggaagttaacatcttggtttttgctgtatgactaaatggttaacagtttgaacattccaggctaatgatacaataagtcagaaatatctgccatcaccaattgaatatgaaagtgcatgatgcatgtgtttcatgaaattcactgtgtcaccatttggttgtttgcttgtcatattgctcaaattaattgtttaatgcattagcatttttttttacagggaacaaccactgaaactgaaatgagaaagagaaggtcaagttctttccacgtttccatggactttctagaagatccttcccaaaggcaacgagcaatgagtatagccagcattctaacaaatacagtagaaggttggtaacaaattctattttcgtttcaattattttcaccaaacttatattgtctcatttcaaacaaatatatttgtgagttgggaatagtgcattctaatgaaaagacagtctaattcaagagctgttatttcttatatctactcagatattctagaagccttaacaatttattttaaaatgagtgatattgggactaagaatgttttcctaactgtgtagcaactctttgaaaatgcagaacaaagcatttctgttaggggtttctaatctcattagtcatagtgaccctctttttgttccattagtttaagacttcagcagtacagcccttttcagcctcatcctaagtactctcaagattgtagaggaagagcaggtcattttcacaaaataaaaacaagctaaaaagatgattcttgggtcacatcaatccctattctagctctcatagtctgaggttgacaatgtagagtcattcacatagggttgcacacacaatatctacaccaccctaaaccatgttcccattgagacgtcacatgaaagaccactcatttaacttgaggccaagtgctgagccacaatgtcagtgcataagacaaaaaactacccattgttacctgggctctatgtgtgtgtctgatgaaatatccttgggaggtttagagtaaactgtaatttttttaacaagtacaaaaaaggttgtctctgtaacaaaaatgtgttgattactgaaaataagtttagtggatatgaaataaatgtgtgtgtataaagtataccttttggtggttcttttttttttttttcttaatctagaacttgaagaatccaggcagaaatgcccaccctgttggtataaattttccaacatattcttaatctgggactgttctccatattggttaaaagtgaaacatgttgtcaacctggttgtgatggacccatttgttgacctggccatcaccatctgtattgtcttaaatactcttttcatggccatggagcactatccaatgacggaccatttcaataatgtgcttacagtaggaaacttggtaagcatattggaaggtaaatgtgtttagtcttcaaattttctgcttgaaaaactgtttacatttaattgtgtatagcagtctttcaaccatccttcatgcttcctggcccctgcaaaatcgcaattatatttagctggctatactctacttttttgccaaaaataatcacccttaatgtgctcacaaaaactgagaaaggcataggcctacagcactacttgaaaagtcaacagcaatatttataatttttcaggatccagaagtagctcatagattaagaacatactttttgagatattattacaatttcccttactgtagaagattaaaataaaattgtggatctcttttatccttcttagtcatcatcactgcaagaaataatttaacaactcaaaaatgtctccagcttttcctcttccaggatctaagtagtacatgtattgtttatccatctattctatatcaaaaccatgaactattgaaaacttccagtacattttgtgtgttatatgattacaaaggtcatttttggtgaagattgccacttaatttttcctttttgtgcttcaaaaacataaattattaaagtgtttgccagtcaactcaacttaggaatactagcttttatttgctgaaggaaagagctatctaaagtaatttatgcatttcctgtaatatttggtttgaagtttaggatttttgatggtagaaaacaaaagcatcatgcataacaacctgcattttattagttatatttttgaagttctactatttatactacagaagtaaatttatttttttcatgtgcataacaaagaatgacaatagtaatgcacctagtataatagataagaatgtataactctgattgagggaaataggaataagcttatagataaataaaagtgctcatgggcaaaatgttgtcagtacttgtggtatataaagtctggacaaaaaggtagtttggtataatggaaagagcactgttaaaaatagatgacttgggctgggcgcagtggctcacgcctgtaatcccagcactttgggaggccgaggcggacggatcacgaggtcaggagatcgagaccatcctgcctaacatggtgaaaccccgtctctactaaaaatacaaaaaattaggcgggcgtggtggcgggcgcctgtagtcccagctactcgggaggctgaggcaggagaatggcgtgaacccaggagcttgcagtgagccaagatggcaccactacactccagcctgggcgacagactgacactccgtctcaaaaaaaaaaaaaaaaaaaaaaaaaaaaaaaagatgacttgtactcaaatcctagttttgccattttcttgctgtatgatatcaagcaagccatttcacccatctgaagacctcagtttccttatctgtaaagtaataattgtatattatctacttcgcgtttccacaaggataaaattaaataatgtatatgaaagtctttcatcaactacaaattgccatacaaatttaagttagtaatagaatcattgtgggaaaatagcataagcattatgttctaagagcaaatcttatgtcatgtatgttattatctggtggaattagattaattttgttttgatcttaggttttcactgggatctttacagcagaaatgtttctgaaaattattgccatggatccttactattatttccaagaaggctggaatatctttgacggttttattgtgacgcttagcctggtagaacttggactcgccaatgtggaaggattatctgttctccgttcatttcgattggtaaaaaaaaaaaaaaaaagcaccaaattcaaaaacctttctaacaatcagggttcttgcatagcaatgtcatagtttttttgccacacaaccattagcattgtaagtttttctgtaacatttgcattgtcaaaaacttttcctacatggaaaaaaattctcaattatttatgaaaacctttatttcaaagaacatagttacgtaaaagttaacgtattactcagttgctattttcactaagtattgcttctagagactactacagttaatatttctagacctaagaaaatatttttaatgaaaatgcatcaccttttaatagtaacttgaaaatatatatagccctttgtagcagtggatgaaaatcagatgtaagatgtgcatgcagaaactttttctaattctgtctctggaaaatatgcatcttgcgaaagtcaaaggagagaaagtctgtaggattactaagcatgcccattaattcacacatatatccttacaagtcaggaaaataattgtagaattataggaaatattccaagtttttcaatgcaggtggatgtaactacatgaatacccctaaggagcattaatgaataatgaacactttacttatatcagggctcagtatgatgttactttgcacactactggcaaattaatatctttcagcagagatatttcagattcagatgttaatattataatatccggccttagaaccacctttataaaacaaattaagaacagttggattccaagtactcattaaaaattcactataagaggcctggcttggtggctcatgcctgtaatcctagcactttgggagactgaggcagttggatcacttgaggtcaggagttcgtgaccagcctggccaacatggtgaaactccgtctctactatatatatatttaaccaggtgtggtggcacgtgcctgtagtcccagctacttgggaggctggggcaggaggatcactttaacctgggaggcagaggttgcagtgagccgagatcactcctctgcactcccgcctgggtgacaaaagaaaaaaaaaaagaaaaggaaagaaaaataattcaccatcagagaaaatgatctacatggttaaaatatggaaaatccagcttttcctagggagtccaaaaattagccatgagcctgagacggttagggcagatcagatattgtaagatattgaattctaatgaccatttctaggtaaagctcaatatatataatgcttttaagaatcatacaaatatatattaatctttcattttccagctgcgagttttcaagttggcaaaatcttggccaacgttaaatatgctaataaagatcatcggcaattccgtgggggctctgggaaatttaaccctcgtcttggccatcatcgtcttcatttttgccgtggtcggcatgcagctctttggtaaaagctacaaagattgtgtctgcaagatcgccagtgattgtcaactcccacgctggcacatgaatgacttcttccactccttcctgattgtgttccgcgtgctgtgtggggagtggatagagaccatgtgggactgtatggaggttgctggtcaagccatgtgccttactgtcttcatgatggtcatggtgattggaaacctagtggtatgtacccacttaagatatgcattttggaaatacaccagcatggcacatgtatacatatgtaactaacctgcacattgtgcacatgtaccctaaaacttaaagtataataaaaaaaaagagtataatttaatggtgactgttttgtcaaaaagaaaaacaaactatgattattggtttaaaagtccattaccttggatatattatcactttaacaacacagcaatatagcagtgcccctgcattttttataccaaattctattttgtcagtcactttatcacattttttatgtgaattacaatagagtatcatattgagatgagcctaaaaggatgtgctgggaccattttataaattcagagccaaggaagagagaagtctaaaaaaagtagagagaaagtgcaaaattaccatccagactaggactaaaaagtggtgtctttaagagttcataatgcttgtgccatttctttgccccattgcagcatatgatattcaatcactctatgtcatatggcagatgcactagccaacctgagttcatcagttctcgaatggctaatgatgcctgagattaccataatggagtaactgatcaatctttatctctcttaaatttggagtgttactgtttatagtatagtaatacataaaatattctaaaggtatgtacattcatgtgccagtctcatggaaatatgagagattattcataaacagctctacttagtcaacaatgaagtatgagaaatataatagattaagaaaacaagtgtcagcctatgttaagctcctaatcttcattctgagttgtaatggttatttttcaattgacatccaatttaatatctttgtttattgaaaaattatagaatgcatttaaatgcatacttggaaacattagtgatttttaagaattctcgtattgtacacatataaatctgttttcttctactcatacaattttagagttaacaaaaccttagattagctcattcaatttcactttacgaatgggagaacttgagagcaacagaaatcatgtctttgtccaaggatgtgctattgagccagtcacaaattcagatcacccatcttctaatcactatgctgtggtgtttccttctcatcaagttttagaacttagagttttttccacacttaaaagaaagaataagtgattgtaatctgctcttccctacattggtgtaaaattataatcatgtttttgttgtttttaaggtcctgaatctctttctggccttgcttctgagctcatttagtgcagacaaccttgcagccactgatgatgataatgaaatgaataatctccaaattgctgtggataggatgcacaaaggagtagcttatgtgaaaagaaaaatatatgaatttattcaacagtccttcattaggaaacaaaagattttagatgaaattaaaccacttgatgatctaaacaacaagaaagacagttgtatgtccaatcatacagcagaaattgggaaagatcttgactatcttaaagatgtaaatggaactacaagtggtataggaactggcagcagtgttgaaaaatacattattgatgaaagtgattacatgtcattcataaacaaccccagtcttactgtgactgtaccaattgctgtaggagaatctgactttgaaaatttaaacacggaagactttagtagtgaatcggatctggaagaaagcaaagaggtaagattctataggtgtgggaaggtatgaatacatatacatatatacatatacacacatacagatgatcctcagcttaatgatgttttgacttaagatttttttttttttttactttatgataatacaaaagcaatagccattcactagaaaccatgctctaaattttgaattttgatcttttcccaggctagcaatttgtggtacaatatactctcatgctgggcaggggcagcaagctgcagctcccagtcaaccacgtgattacaaggataaacaaccaatatttaccgtacagtgtactgtattcaggaaattacctgagttatccaacagtttattataaatcatgctttcctttagatgattttgcccaactgtaggctaatctacatttcctgagcatgtttaaagtagactagggtaagctataaagtttggtagttaggtgtattaagtaagttttgatgtacaatattttcaactcacaatgagtttatcaggaactaacctcattgtaaattgaggaacatttacaatacatgcattatattgcctgtatttattattatatattttccatatagatttttttgacatcatgtaaaattttatttcactgaggaacaaaagatttaactcggaaatgactgataaattaaagggtaatatagtatacgtgtgagttttctcatccttagtaatggatatttgttagatgaatgaatgaacgatctaacaaatagacaaacatcatcagatttaatccttacaataacctggaaagaaatgtgttattatgttaacttttcagataagaaaattagcttagggagcattaggtcacatagctagtgaggggagtgccgagagttgaacttagagcccttgtttacaagttctgtttattgttttttgcatcacattggctcatgtacattgaagagaacttaacaacaagaaatattcttgtagctccttcaactaaaattacactgccctatgcattagcctgtttggactgccataacactataccataactgggtggcttaaacaaccaaaatttattttctcatagtccagaaactggaaagtccaagatcaagataccagcagcatcaatgtctagtgagggctcactccttgggttgcagacagccacctccttgctgcgtcctcacatggcctgtcctcaatgcatgtacatggaaagagagagaactctggtgtctattcttcttcttataagtgcaccagccctatcagaataaagtccaacctgtatgacctcatttaacctttatcaccaccttacaggccctatccccaaatacagtcatattgaaggttagagcttcagcatatgaattttgtggagacaaaactttaatccatagcaacctactttgaaatattaagttaaaagtctaatggatatataagataattaacaaggagtctaggacaaagcacctttacttcccatttagtgtttggaaatctcaaaaacagcagggtgcccatcttttaggctgtatagtctaaatattttaaaggattgaatacattaaagacattttattagagatacaattctattagatatcatcatgtccattgcattttgatagttgtccatggaagataccacaggtatgtgacattcttttgatttagtgactatatcccttaaaagatgcttcaagtatttataatgagtctctgaataatctaggtcagcctccacttttaggagtagggggctaatattggagctggaagcagctgccctgaccctagcattagagctgcttagttaattcagatttgtttgatgagagaagggaaagaaatatagtgcagagatgtaatagtagatagatcctgtcacatttccatgtctatggaaatagattcaggacaaaaaaaaaatagactgtttttatcaaatattgtggacttttttacagaaattttaatttggatattatgtcagttcagactttgtttatttgagttttcctaaggaatcagatgaaggctaattttttgaaaaattgttgtctttataaaattgtttctgaacttctgttaaaataaatttagtaatagcctagtctagcttcctttgtcttgaatctttagacctacatttagcatttgatgaggactaatggctaccatatgctatctgttatattaaaaaggaaaaagactattttacaaagaccatccataagatatacattttctgtaaaaatttgacatgattcttactcttattgtttttttatattgatcaaggctaaaagaaacactaacctttttataaagcaactatccactgaagcactagaggtagttctgtttctttctactttgtggtattttatatcttggaacattgcattaattgaaattttaaatgttaaggtaatagaaactttagagataatttaatgtggtgcttctcaaattgtgagtcatagtttagttagacttgagaaatccctttaataggccagtttttttttttaattttaatgaaatagtgatccgcccacctcagcctcccaaagtgctgggattacaggtgtgagctactgcacccggccaatgaaatagaacagaataacgttagagcacatttcatgtcagagggagaagtcctggtaaatgaagcttttgccacctgtgctgaactttaatgttttgtttgtctaattagaatgcaaccacttggttcatgggcatagtgtctgaagtccaggagttcttaagcttcagaaagactgtttcagctttttgaaggtagtgataatgaagccttcctaaccctaggcagaacagattgctttcttttttggttcccagagatataaggcatagagtatagtaataaataatgcatcttcttgactcatgcgtcttacaaagtactatcatattttagggtagctacttatatgcatgcatgtctctccttttatgtggtgacctacttaaacatgtttggtacaaagtagacactcagatcaaacttttccagctcattcaactcttcttaataaaaccattctgaagggctctcataaatactttctctgattagagcatacttgagattgtcattttaattccaattattttggaccaattttttctctagattcaagattcacttgagttagattttgttgtttttgtttttgttagccatgttaccttgtcactttacaccacccttctaagaaagtaataatctctcatcttttccacatgaattgctgttgaaatgcagttgtatctcatccagacgaaattttgtaattaaatactgaaacttctatttatcccctaatgatacatttcaatttcttttattcatttttgaatctggctttctttttatattctttcacagattaccacattgtatcaaatttcctggcacttttacttcacaattcctttcttcttggtcagaaataaacccacacaatattgtttgccctcattgcttcatcagtcttatactgtattctgttcatcaaagtaaggcataaattatgagatattctgcttttagaggaattaagctgacagcagatgccccaatagatgaagagtctttgttctacattaggaatgctgcctgtagtatattaatctcatcattttggttctttttgttttagcctttattctttttgcctattttcatttatttatcagttatcatatgccagggagactagataaaggagtatactaataagctataaggaatgattttctctctctgtctctgtgtgtgtgtgtgtgtgtgtgtgtgtgtgtgtatgactttcaacctttaagtatgaattttcatattgagacatatgttactgatgcaaaaatgttacctttcatggcctctattagactagtttcatttgaacatgttattgtttccattcctgaattccagtaatgacttatctacaatgcatcattataatacctccaaaattatattaatgccttgtgttaaaattacaagtgcccactgtttattcttcatacactaaatatttgtttttagacatgtgaggccacagttataaagttggtaaatggttatactctggagccagatactgggttatataatttcattttagccgcttactgtgtgactttacctatctaataatcagtttcctcatctcaaaaatgtgcataatgttactgactgcatttctgggacagagtattaaatgagataataaatgtgaagtacttagcacagtgcctaattaatatagaatatctggtaaatcatcattattattgttaccagttgcattccacactgttccagtaagttttcttacaagaattactactggtaacatactccactatttgtctttttttgttgtttgccttttgccctctgtaataaattgttttataagtttatctggggatggtgatacattttatattttctgtttatttttaaattgttttgattacattcttgatatggtaagctccttaaaatatttaagaaaattacttttctaaggggcattccaatcaggaaatacaaacatgcagaaacctaaagacaggaagcaagaggatgtatttggagacaattagtagtttggaattccgggggcgtaaatcacaggagctgaggatgagatgtaggtaaagagtcttggtttccaggaagcaagaatagactggtatgaagagatgtggtgaactggaacctcatatttattttgcctcttacatctgtggtgaactcacacctaactatcctccattccagagcaaactaagggctgttttttctacaccttcctcctattggtctccaaaagaagaaagggaatagcatgagtcacatttcatcctctctttaagtcctaagagacttcaaccttcaaagtacattcaagtaatttgaggaattgttttttaaaacctcagaaaatttcttgactcatgccatagtaggaataatgataagctagaaacatgaatttttattgaacattaataataaagaatggtgacttggacagatctgagagagctttgaaggctgggcaaaactgccaagactatgcaaaagacaatataaaatcttatctccccaaatagaaagtaaatttattttggttttggatagtattttataacatttctatcctccgaagcacctaccacaatgctgggtgcataacagttgcccaataattttttgaggtttggttgatttatatggatactagattaagagcttataagccttaactctactatgagcaaatcgctaaatctatattaccccgtttcctaatttattaaatgagatatctgtcctatgatgcttatagaaatgttatgaagatctaaaagctatttggaagttaaaaatgttcaaaagtgtaaggtgatgtcaagaaaattactacttaattccatttaaataaaaattttaaataaattgagttattaaagttgtaccttttgggaacaaaaaaggcacattactaaagtaattataaaagaaatacatttgtttttgcgatgagtgagctctagaataatgagtaaaaatgtgaggtccttagtaattcaggttatgttaataacagctattgtttaaatgttcaccatggacaaagtactattggagggcatatattgtcccattcagtctttatgccgtaagacacactgttattccagccttaagatgagaaaaataaacatattttgaacaaaggaaaacttgccaaagttacacaaacagtaagtggttggtcctggcagtctgctccatagtctgctccagagtcacgctcttaaccgctacactaaatcttaatagtgtctgaaaatgtactttctttggcatagttctgaaataaataatactatttgttgaagaactaggtacaggtgtcaactatagatttggtgttaacttccaatcactgcacattgggcataggttaacagcatagtctggagtgtttcagagtcctcctgcttagtcctgaaaggtcctgttcctctggtactggcctgcactttaggctgatctgcttctgcatcccacactgacctgtggtggtctaattctacttagagagcacttagtctcccagagtgtgatagttgtgcttaaggagcatccccttctgagtttaaagctgctggaagagtcttccaaatcattaggaagaacttctatgatgtatcattagcttatgaggtctttgagaacaggaaaaacactaaccctgtcttcccttaagtccacagcacatacaacatatttattaaatgaatgaataaataggtgatgggcagttacttctagatttccattttttcccaattatatcactgatatatatgcattttaaatctacttgttgctttgctgatatttttccatctaatacttttatcttacgttatatgggttaaggaacatacgacaatctccaacctaagcacatagtctctaagagatggcaactactctctgcgaagagtactatccatggaacccaagagtactatctccactacttctaattgatcactagggactgccaaagctacctatctttgtccacctctctgcattcccaaggcctttacccagtgtcagacctccatcatcttccagttttactgctacagcctccaaacgggtctcctctcgctagtgtagtcttgacaaaacaataggtggtctttctaaaatgcaaatcccgtaaccgttctgtcctccctaacctttcaggagttgcccattgctcacagtatggagtctatactacttaacatgggtacaagtccctgcaaaactgaccaccgctgactccttcagtatcatggaatagtacacctcacacctccccacccagctatactaatctttcattcaatgtaattccctatgctttatcagttctcatcgttataccttttctctctgacaggaatactctcttactctatcctgcttcacctgactcatcctcacccaccacatccttcttgtcccaaatgtcactttattctaccctgtccttcctagattgagctaggtggtgttctcaatatactctatactactcctattagagtgtgtggcaattgcttctctgtatcctccatctgattgtgaaccgacgagggcagatactaagtctattatgttcactattttatttttcaagtcctagttttgatgcctggcacatttttggtagtgaaaaagttcaaatatcaataattacacctattacaaacaatacaatactgtgatggaaattgttaccatttatcaaataagcatacgccaaacgttattcatgtgttatcttgttcagtccttataacaaggatgtgaagtaagaaccattttacaaattagaaacctaaagcctaaggaggtcagaataattggttaaagtccataaaaccagtgattgtgattcaaactcaagtttctctgatcctctgaacagtagtactttcaactctttcattatatagatatacagtttatttgcccagtagacacttattaagtatgttataatttaacattaaaaatcaatgtcaaaataacattatagaagctctgtgctcaatttggcaaaatgaatttaacaatgaaaattactcatttgatttgcattttggtttctagcttggggattataaatgcaatttttcagaatttttttgttttctttccaatttttttgtattaccatgattttctattgactcaatatgtctgaaatatgttgcttttgttcccttatatttaattattgatacagaagtttatgtgtgacctatcgaaagcaaaattcagagtagtatattagagccgtattcctccacgttcacttttatactgggcaagtgtttgactaaagaatagaaacaactgacattctgtaaatatgaataatcactgaagattgtcctttcaacatacagcttgatgaagaaatcaactgggaataatgtgggaattaatgagttaatatttgagttttctagctgccctgtggaaatgttgagtctcattacagtgtcttttccattgatattatattttcctttgttgagagtctttaataggggtcattttaatttttaatatgcatagtgtacaatagaaatatttactagtgcacaatgtacacaatgaaatattaatactagcatttctgaggttgtagagaacctcattttagcatgacttaggagatatatgtgtcacaatagtaaagtacccagcattaaaatagtacctgtccagctttaaaaataagtactttggataatattctttatatgttaaatatatacatgtgtatgttaaatatatatattaaatatatatgtacacacatatatacatatacaaatatatagacatcgcatgaccacatattaagtatgcttttgacccttaaattccagatttatttatattacttattataatttgaactcctactaaactctataaataagctccttataacaaaccaagtttaaaaataaaaatataaacattgtaggatcaagtcagagaacaagaaaaaaagcatttaatcacttactctcagagaatattgaagaaagttttctttgccttgctttgttttgccttaccctcaaggtcaaaatcatttgctatagtaaagagcattgttaaaaaacaagaaatttgcataaatccactgcggaggaaaactgctcttaccatcagggttgtagttattaagtggttattgaatgccctggtgtacaaggcaaagtggatgcttcatatacaacgtggtctctgcattctgtcagctcacatattaagtcagcctgccaaaaatacatggatgatacaagtcagtgtataagtgtataatttagctattaagattcatgtgtgaaaatatacatattcttaaataaactagcctatttagaaattggtaaaatttaaggttgattcatggtttaataaacattaaaatagattttaagaaatattccgggaggccgaggcgggcgaatcacgaggtcaggagatcgagaccaccctggctaacacggtgaaaccccatctctactaaaaatacaaaaaattagccgggtgcagtggtgggcacctgtagtcccagctacttgggaggctgagacaggagaatgacatgaacctgggaggcggagcttgcagtgagccgagatcacgccactgcactccagcctgagcgacagagcaagactcagtctcaaaaaaaaaaaaaaaaaaaaaagaaagaaagaaagagaaatattccattaatctctaaaacagtgagaacaaattactttattagtgaatagcaaatttcaaaatgaaattaaatttcaatctaagaacaaaaaaggaaaaattaattggccttactgatttttaaatctgtaaaaatacttatttgagaatattttagttttgccgttattgaatttctttagaattttatatgaattcgtatttcatgtgctaacatagaggtggacttttcctacacatctgaagaggagcttttccttccctttttgagtatttaataataatagtgttattatcccaatcaaataaagaattggaccacttcatcttttatctcaaccgttataagaatatattgatgcaaatatactggttatgaaggttttaatacaacttttttagcctatggtaaaatattttaaaaaatagatgacaacatttagattttggataatattaatagcaaaagtaaatatgactgtatattatctcaaaaaacatatttacagaaaatttttattttcaagggttcatggaatatttctataaaagtaaccatatactggagttcaaagtaaagctcaataaatttaaaatagctggcatatagggttatccagtcacaatgtagttaagcctgaaattaataataaattgatagaaagaattccaaccatttgaaaattaagaaattgcctcctaaacaaatattgaataaaagcataataaaataccaaaatagctatttcaaaaataaaagcattttatgtcaaaatttgtggaagaagaccaagtagtcattaatatgacttaatattactaatatgattaagaagggatgaaagaacctaacaaatatctttgagaaattagaaaaggaacaaaaaaggaagaagatatacataaagagaaaaaatagtgaattatcaatgtagcagacaatattggtataacaggttatggttcttaggaaaaaaaaatcagtaagacacacaaactttggtgtatcaggcagaattctaagatgatctcaatgacacttgcccttgtataatccccactccatgagtgtggttggaacctgtggatatggtatcaccctttaattacattacatttatgacaaaaagggggatgatgctgggtgggcctgacctaatcaggcaaactctttaaatgcacagtgatttctcctgctatcacatagaggaagctgaaaagatatgctctgcctggcctagaaaaaagcaaacacccatattgtaaattgcatacagcagccatgtggccagagactatgggtggcctctagttgctgagagtggttctgggccatgagctggcaggaaagtaggaagcccagtcttataattatgagaaatgaactctgccaacgacagtaaacttggaagaagatcctgagccctggaaaagaactggatttccagccaacaccttgacatcatctcaatgagaccctgagcagagaatccaactaggcagtgccagacttccgacctacagaaactgtgagttggtgaatgtatgttaagatgctgggtgtatgctcatttgttacacagacacagaaaacaaatacatttggcaaataatccttgttaggaaaactcaaatgattttctatgtgtaaagagcaattgcaatcaaataagaacactaatactccaatagaaaaataggcaaaagaccaagcaccgtggctcactcctgtagtcacagcactttgggaggccaaggtgggtgaattgcttgagctccggagttcaagaccagcctgaggatcagatgctgtctctacaaaaaatacaaaaattagccgggtgtggtggcatgcacctgtagtcccagttacttgggaggctgaggcagaattgcttgaacctgggaggtagaggctgcagtgagctgtgacttcatcactgcactccagcctgggtgacagaatgagacctgtctcaaataaacaaacaaataatagtcaaaagagacaagtcataaaaaatataactggaagacaaaccttaagaaatattactcctaattgttatcaaataagttaatatcaaaacaatggtagtgtaatttctgcttttcaatttggccaataaaaaagaagaaacaaaagcaaaacatgaaaaggaaaacaaaacaaaaacccaggtaaataatgcattatgctgatgaaggagatccatgagacagatacttaacacaaatctcagaacatggtatctttcaataaatgttgagtaattgaatatttcatatacagctaatagtgaaattaaaagcccagctacatgtggatggtttctttgtctctaaggtgggaatagctatttgcttctccttggtcagagatgatcacaggatttttcatttatttatttgtttgtttgtttgtttgttttttgagacagggcctcactcggtcatccacgccagagtgcagtggcgcaaccacagctcactgcagcctcaacctcctgggctcaagccgtcctcccacctcagcctccaaagtagcatgcaccaccacatccagctatttaaaaaaatttttggccaggcgcggtgtctcacactgtaatcccagcactttgggaggctgaggtaggtggatcacctgaggtcaggagttcaagaccagcctggccaacatggtgaaaccctgtctctactaaaaatataaataattagccaggcatggtggcaggtgcctgtaatcccagctacttgggaggctgaggcaggggaatcgcttgagcccgggaggcagaggtcacagtgagccgagattgcgccattgcactccagcctgggcaacaagagcgaaactccgtatcaaaaaaaaaaacatcatttttttttcttttttttagtagggacagcaggatctcactatgttgaccagactgatcacaggacttttttagccacagtcccaacatgttacccagactgtgcaggcccagcagccatacccactctgaacttcctcatccttttctcctcctgagtccagatctgctccctcatcaccttctcatcagtcctcacttcatatctctcttggatttaagactgtccaaatgtatcatttcaaattctcaaacactacaaagtcatagaaaattaaagctggaactttaaagatcatctcttcattttacatatttaaaaaatgggctaaaggaagaattatttgagcaaagccacgcagaaagtaagaggtcaaaccaggtctgggtttctttccagtttattgttggtggctttctttccactactgtggcctgggccaggagaagggtgaaaaaataaggttgttggctccactggaggccataacttgttttaaaagttcttggaatagtcaattcagaaatggtgagtgacagatgtggtttggctgtataaagtaatttacatcatctacttactccatatatggatcattttaccacatgataatgtatacacatattctgcatatatgcaaataaaatgaccaatatgcatacttattgtaatgaggtatagctataaaatattcatagaggcaccatgttgaatttaaaaagagctttaaagttgagaattttgcatcctagtttgtttttttttaacctattgtgtgctttttgccaaatcaattatactatccaggtctactttaccaatctgaatattgcagttttctgaggtcatgttcaattccaactcctctcagcttctagtaaaaaacctgagtataatttgtcaagtttacctgattggtagtatatgttttcacgtagcaaagctttcacattttgctgcttctgtaagcctggttgttggtacttaacattaaaaagtcagaactactaattatttatttcttgaagaaaaaagaaaacattgtaacttttctaaaatgattcggtgtgacatgatcaccagagtgacatcccattacttttgccacattgtattggttagaagcaagtcacaggtcctgcccatacataagggcaggggattatacaagggcatgacaacagtggccagaaattttggagaccatcttagaattctgcttactacagactgtcatgaagaaagcatgtttgcagacataaagaagagattcttacatgtcattcaacatactgtcaattcttcaagtttatagattaaacccctgaaataacttttttaatacccacaaagatactgtctcttcacttggtattaccccgccccccacctagttactagtggtgttggtgacaaattctaaactttaagagcctttttaaaataatagctctttgcattagcttagtgccaagttgtttcatctgaaattgctaaatcttgaagatttttttcattttatcaccttttttccactgaaattcatgatactaaattccacataatttcccctatattcaccacacatattttttctttcatttaacatcatcttcttaaatttgggcatgcatttccccaaattttgattcaattatggttttccaatacattttcaaaattttttaaattttcatttatgtatttatttattttagaaatgggatccagctataatgctgaaattgttcccaaacttataagttcaagcaattctcctgcctcagcttctcaagtagctgggactatagggagttttccaatcttttaaataatattttaatcaaattttttcatgtatcatgcataaattagatgaaagtggaacttccctgcttgaattaaagccttcagccacttaaggctggagtgagatctctggagaacattggctggaaacacctcttctgtcatattagtaggacagatgcctttcattgcaacatacatactgaatgttggtataattgttgattgaaatttagctgtacaacttatgatctgcagatgatagactttctctaagttctaaagtacattaaagactaagcatatagcattttagaaataatttatacaaattatgtgtttaagcttaatgcctttcttgtttttataaacttactatcatctttgagaaggtctgggtgacttttatattaatgtttttatttattttaatctattgactatgtaaaaggtttactatttgtttaatttaattttaatttctgtattgtattccttatttaacatgccaatcaaaactcttgttgttccccatgttttggctaaaaacagtttagttcggtcacttgtgaacttattttattttgtttgtttttctttcctttcttacactaatgctcatttatttacattatatataaatttctagaaaaagcactaacacttctctcaggttatcatagtttatctagagtaattcattgacataagccccactgcttatggtttaatctttctaatagtcacatgtcactttttctgatgttattatgatttgaaagtaggggaaaattcttcttactattatgagaatcagggtctatcataagggttagccatgatgtggcttaccagcctccctttgcaaaatgctgacttgcgaagtagagcttaagccaaatatgaataccattttttaaatctaatttttaatcatatattgttcctgaaagatgtatacacttctctggatcccaaacattcaactgctccatttatttacaaaataaaaatgacatgtataaaaatgtcactttaggtgccttgttccagcatgggttcattgtttggagtgctacatcaatgttttagcatgagctgcacttgtaattcatcatctattatttctgtttagttttttttttcccccagaggacaaatatcttaacgaatcatataaagcaacctgaatttagtatcttctcagaaatttatatttgtaactatttaaaaagtaaatattcacacctaattttatggttttttaatgtacatgtatctatgtgggggatttaccggtgttacgtttattcaatgattttgacttagtttttataaatacaacaacactttttaaatgcatttttcaaattctacaagattaaattacacacttacagtattttagaatagtgtaaattgatttgaaaataaacataacttattcttgataagcataccattcagctggtgaaaatagaaatgtgcagatatcctaggcagtagccaacgacctgagcaatttttgcacatcaaggtcatcagttattgtattttactgagaaaactgcaagtgtcattaattttgtaagtaagtccattagaatgaagagaagttataataaaatatatgcccaaagtagtccctgtaaagtgttgaaaggggtttaaataagagagcaattattactcttccgcaatgatgggaggaaaaatcactaggagaaaaagtcagagaacattaagaagttcaccttgggccgggcgtggtggatcacgcctgtaatcccagcactttgggaggccgagacgggtggatcacaagatcaggagatcgagaccctcctggctaacatggtgaaaccctgtctctactaaaaatacaaaaaattagccgggcatggtggcgggcgcctgtagtcccagctacttgggaggctgaggcaggagaatggcatgagcctgggaggcggagcttgcagtgagccgagatcgcgccactgcactccagcgtggacgacagagcgagactctgtctcaaaaaaaaaaaaaaaagaagttcaccttgattaacatacagcttctatctgtgaaagacaaatttgggagatttggttggaactctaagttgaaaacaaaaacttcatccatcactaatatctgaaacagaggtattcatctattcattcattcaccaaatgtttgttagtcattcaccatacatacactaagctttgtggaccacaaaggtctaagtcacatgaggctagaatgaggatggccatttttatttatagttaaacaaagaaaaggtaacaagaataaacagaaatttcataggaatttggaatctgactgagaaaatagttatttcagagataaaataaggaaaactgacttttgattactgccaatgtttgaaataagtaaaagtaaacaaaaaaatttgagtctgggtgctgaaagagtgatattgcagaatcaggaatttggttaaagaagtatgtttaagattgtttaaaaagtcattacttagattgagagcatactaaatttgagtattattaggcacacctccactttcctacagtagttcagacagactgtagaatatacttatattgcttaaaaaatgttttaaaattaatttgtaaacatgtagaagatcacttgtctagacctgcgaactttccaagtgcagatattccattggaatgctaataagggcatttgatcatcttttaaatcaccttaaaatttctgaaatatggagtgactccaagctctatgcattaaaaaaagaaagcacacttagaagtatattgtatccatccattgtgactatctttggctttgccattaatgttttacaatttggagaagtaacactattcaccaattcctggatctacagcccacccatggtcccagtttgtttataaagtagtcctcatgaaatagcaaagttattcagaaacatttaacatattttaaatataagataatttagagttcatattatcttgtaatgttcatacaatcatacagttcatacaatcttatgttattaatatccactacattcttcaagagttaccaatgtaatatgggtacttacaagcgcttgctcatgtacttaaaattagtagtaagttttactttcctaacatttagtagacagggtagagttcgtgtatgtccaattgcatgccaactcttatattgttcaattttccattttgatgttattctcatattgtgttacatcatcattacactatcttggttgagtaactcaaagggataaaataggaatggaaatcatataaacttaaaactcaggtttttttgtgaattgagactctaatgaaaaaacatcagaagaaccataaatctacatgtatttttaaaaagtaattctgtaagagtgaccatcttaggtaagcatcctaaaaataaatgtctaaataagaaatataagatgaatatctgaatattaaaacttattgaactgttgatctatttgtcttcttcagagaatgccattttgaaaatgtgtcaaaaagtaacataaggtcttttgggttctcgtaattttcacagaaaatagtcacaacttaggtaagtcagataagtctttgtcttagaaaaagtaaaaaacaatgctttaattcataaagtgaataagtggtttcacttaaaggcagaataaaaatcaatgcttcagaggtatcattaaaagtagtattcctcataagaaaacaaatatggttggcaaaaaagcaaaactagttattggcaatactttattatcagtgtatcagtatactttaatatcatgcaataacaattgcatgatattactagtaatcaaggaagaacaatttttatgtacatgttcatgccaggatctaattcaccttacaattggataaaacacttatgtgcaaagaatcaatcatttatctgtggcacttacatgaagattaattactgagcaactttttgttctgcttattactgacaacctatactgatgaagagtagatttttatgctaatattctattattttgtgagtcttggtatagactggaaaactatgtggggatcagacctagcagataacaattatatatatagaaggtaggtttgctattataattctttgtacctgaatgcctctccacacaaatttattcacaggaaataatatcctttctagttcttaattaattttggcgaaaattgttaaaattctcaaattccactctctaattgtttcatgaagaatgggcatttgcttttctacagtgaagaacaatgggtgatgaaatgttgctcacatggtttttataaagtatgtaatgaatttcattatgtcccggatagtgccaatcaaggtcatttttaaaatatgaaggcacttgttgaagtgacaagtcttagcctatcactttacggccaaatgatgaatctgtgtaatgttgaggataagacataagaatttcttcagaagatcatgtgatgttatgagtagtttgattgagaatgtgactaacgcctgccactaggtgattctcttcgtttgtcagaggaagaaaccaatgacttattcctggatatgttttaaattcagtgcaaatgctagaacagaacacaaagatagtcaaagctaaatgcaacccgaaagtagattatgatctatttactactgtctatcatgttgaacaatcaacttttcagcttctgagcatagtatgcaggcctatttaatgtgttagaatgttgaaattagtcttcagtgagaaatattttataatttcaaagatcatcttcaacctgaattcacagagctatgacagagctacatgccattataggtcctaattttctgtaactgtcaggtaagtttttctattttaagaaattaaaaggaaaggaaagaaggcaactagatatggacccagacatataagctatccttcttcaagcaaatacaaatatttcggtgaaacttttactgaaatatcaacactctcctatgtatgtgaaattcatattaacaattttaatattgtgtttaatttttactatttacaatatcgtgataacgggttgaatggcttgctgctgtgtgcactggaatgcctattgtcgggtctacataagcctgaagtttagaaaatactgtactagatttgatactccaataaggacaatagatatttcagttatcagtgaatactcagctggtagcatattgttggtgttcaaaaaatattagttgaataaattaatgaattaattacacttgccaaaaacttataagccagtttgctggtcttcagaaagagcgtcatgagtttttcctatcttaatatgttagttaatattttctattatctctgccatctttgtcttctgagaactctagaaagagaaatgtgcatcccatcactattgtcaaaatatgaaggatattgttattgttgttgttgtttaactagattttgttctttcagcttcacatggcacattaacataaacatgatttgtcagaggaaactgaattttcccacacactatttatctcattttacaacacttcaggctctaaaatacttgccagaaattgaagatgtctatttaatatctctaaggttgtttattgatgtaatttttgacatattttataacaatttctctccaaatgaccacatttatagtaaataactctgaacaccttaaccatgaatcttagtaacataagtgaaaacaacaggtagtatctgtacacacaggtaagacattgttaaagaaatatgtaaagtcaaacattaaactgcagaataacctaacgacattattttcttctaaggtaagctttctctttctctcctgctccttttccctttctcttcctccctcttctcttccctgtgtcccctgcttctctaatccacaaggcagtgttttgctcagtacatgtggctgatggccttttgtaacctcataacatagcaatctgatttcaagcttacattgtgaattatggtaaaagggttagcacagacaatgattttcttatttcttccccttattcaatctctctttttctctaaaaatatctctacctcaagaagaataaaaaacaaattcatagtaataatcctttcttggcaggcaacttattaccaaaattaaaggactttactttctatgtccatctcacttacagaaactgaatgaaagcagtagctcatcagaaggtagcactgtggacatcggcgcacctgtagaagaacagcccgtagtggaacctgaagaaactcttgaaccagaagcttgtttcactgaaggtaaagaaaagaatcctaatgttaatctttcatttggagtgcagcttgtttagctgttggtcagctaaaataaatcacatataataaaatggcactttgtaatagatataattcaatcacctctaatatgttgacagacaaaaaaacttaaagtctagtgtcatgctttgattatatctgcccaatatgtggaagagattaagaacatggaggaaaaatattttagtaccatcaaaacttctaacttatatttttaaagtaagtagtgatttcacaataagttggcatcttagacactactgaaaatgatcctacacagaatttgccttaaaagtaactttctgactgctaaaactaaacggattgctagtgctaaattgtgtttctttaatgaaaacatcagtttccaataattgttggatgaaatggggaataaatactgccctagaaactctatacctaaacagtcactagttgagcctggtgcagtatgggcaatagatagaagagatatgtttttcctacaactaatatttcctgtggtctgatatccctgggaatttgaggtttggaaatatgcatactttctatttgatgttattttttcataggcctagtataccttcagtcttcttctattccctatacaaatcatgcatatcacttaatgtccttttcaaaactgccctcatctgaccatggtggaacagcagcttgttcctctgaatggctgtaagaagtatttccatttaatttacccgataatatacattatcctatgaaaactctttctctttttgaacagttacatgttacttttctatcttttttctcttcttttcctccattccttcactccttagttccttctttcctccttcccttcttttcttcctccttttctccattcattccctttctcctttttcttcaaacatatcttttcctccttttttttttttttgccttggagcagggatcctgtatttatatctttttcttttttttttttttgaaaaccagattttttttggtaaggttcttgggagtaaggtacatgttcggtgcctttttgtgtgtgtacctaagtgcctttgtgcttacaatggtactcagaagtacctgttgattgcatttagactaagtgaaagcaatgtgtgaggaaggcaatgaaaagtcaaagccaaatcatacaaattagcttttagtgaactaaattaattatgcaaattacataagcccttctaggcacatcacaaaaaatcctaaatggtaacaaatgcagcattgttggaagagatctacatttttactctatatcctttataaaagggaagttttctgcttaacattattaatgtccaatttaaagttcttttctggagtgacttcaacagagtgcaacaggatgatatggtacaaggaaaagctacctcacatttatttgtaatttacaaagtttctcttggacaataacactgtgaggcagacaaagcaaatactgtccgctagggcatcatttaaagtggctgaatgtttccacaacttcacacagctgatgaatgtgctcttactactctaggcttagagagctatgctagcaagacagagatgagcatagtaataaaaagacaagacaaggacattgctaaaggatattatggaagcagagacactttatctacttttatttcaacactttctgcaggctgtgtacaaagattcaagtgttgtcaaatcaatgtggaagaaggcagaggaaaacaatggtggaacctgagaaggacgtgtttccgaatagttgaacataactggtttgagaccttcattgttttcatgattctccttagtagtggtgctctggtgagtgagattaagaaaaggtgatacagcactaatttttagaacactctaatactgatgacttattaatcctttgtttcattgtcttagtatccaatgcatttttaattatcccaccttgtatcttctatagatttactctataactctatatttctggattaacttttactatgtatgtaaatataattttaagaagctaatcattaatttttgcttactattaaatagcccagaaagtgtagcccttcagcttattcattaacaccaaaggatgtgaatattcaattactcattgtttaattaaaaaaagttattggaagccctgggatgggaatatatattctctgagttctgacgaattttgtttctaaatggtatttattattattatctcttgatggacagtagtaagtccttagggaccacttctctgtctttttccaattgtgtgctcactatttttgtgctacttaagaaataatgaaagttggtaacaataaatattgggcagcatgcccaagagattcatttaaggatgggtttatctttataacaaggtgttcacttcatcagaatcaatttatttttataggaaaattatttataaaactataaataaaacatacagatagcattttagggaaacactaacacaaaggaaataccatagatagaaaaagagaaagaaagagagagaaacagagtttgcctgattgaaatgcaagtgtgttacaagtttaactttttataattctaacacagacatatatttacctgtaatttttctgaagaaagaaatattttctacacgctactttagaagtctttcaccgttgaaaggaatgcatacttagaagtgaaacatcgagaggttcataatagaagaatatatattagaatctaaatgaaaagtaatttcatttaatcattgtcacactgtatgtctgttgagaaacataaattattaaaaaaataacaaacaacaacaaaaaagaagcagatgaacccaactatttagtcaaattggagactgcgaagatcaatcacaatttctgctttacaaaagcacaagctttcattatttcttcaacctcctttctatagcaaaaaaaaaaaaaaaaaaaaaaagccaatagaaggaagcaaaataaatgaaacaaaaggaatacataacttcaagttgggatggccacatcaggatacaacatcaagaactatttcctgactaagtcaaattaattcattggaatcatacttttctttttcttccaccaatagtctttcccctgattaaataagtaaaagacctttgcgaggaaaaaaaaaaagtaacagtaactactgtttctctgccctcctattccaatgaaatgtcatatgcatatgattaattttttaaatagcttatggagtataattatttttgaaagctaataatgtgtaacattttctttataggcatttgaagatatatatattgatcagcgaaagacgattaagacgatgttggaatatgctgacaaggttttcacttacattttcattctggaaatgcttctaaaatgggtggcatatggctatcaaacatatttcaccaatgcctggtgttggctggacttcttaattgttgatgtaggtatcgttcatatttttgtctctgttcaaggtagcttgtcttatttatattcaaattctacaatagtgagtctcagaccactatgttatgttgacagactataataaccactaaacgcatatatgcaatgagagtgtcatttctggaagacaagggctaatttaattctgatttaaaataacattgggggatggaatctatggtagttctctagttatctgagaaagctaaagaaaaaacaacacatcagcagtttgtagggaaagtagtgaaacagggaacttaaaaggtatgttgcttaaatcctttatgttgtgagtcagacagactcaagtttgtatcccaggaccatcacttgttgattttgtgccactgagttagtttcttggccccaaactcttgacccccaacttgtacagtattaaaggcactcaataaaaacagtgatgctgttgggtgctacagtcatttaaaaaaattctatttgatctactcaaactttttaaagagtagatttaaatagtagattatatggattatgacttcattataggaagtaaggtatgtagagtgtagggaaagagaagtctactttattcagcagtgaaagttttcctagaatgtaaactagatttacggcaagcccaaacagccctttatagaatttgtatccccaatgattaatactgcatttactgaaaacaagtgactgacttcaagatgtgttaaagttaagcatcatgttttctattatcaacttggcaaaatttcagctttagaaagctacagcaaaactatcctgatttcatattgagtagttttaccccaaaaagatactaacccagcaagactatgagggtttcttgtggaaagtgtttcttgagctaagaatcatgaatgcattatatttccttgaccctgaacaaaggcaaaactaagctatttaaaaaacttaacaatgttactgtgaaatgagccaattgagagaaatctcaaaggaagaattgctttatcacatcaataagggagaaagtttgtaatattgaggtttcaagcattagaagttacattatgtttcaatttcagaattgtttacactataatttaaatctaaatgtaatttaaccctttaaaacttcctgaggttttttttctattatgtttattacacatcagctttttcatgaaagttttttagtgtcatttttgaaacattttaagaaaataattttatagaaaattttgtagtttgtaacaataatatctttattttcaatgttctgttttaattctttaatgaagatcagtatagcactctataaaaggactaattacagcacatctcaaataatgtaagaagtatattaaatatgatacaattaatacattttaaaaaagaaaagtttacaaaaatagtgtgcagtatatgcggaattctccaatactagcatctttctaaccaaataagttataatcttccttgaatacaaagttttagtaaattccttatttagagaattagatacgtaagatttttcctttagtcatgtatattacctacaaatgaatacaaatgaagtaaatttattgctgtgtgtatttggtaaatattcattgattggccctttggggccagatatcatggcagaagccataaattagtataaaaaattttgaggaagttttgtaatggaatttctttctaagttacttatgtaaaaataaacaagtgaaaatgcaaggtattaccaagacaaaatatcaccttcaaaactgatgtagttcattaatttctgagaataccaattatgattagttgaatatactgatgcacagtagaaacttcctgctttttttagtacaacagcagtttttgtattttataactagctacaagaaaagccttaaattcaacagcaacttaataaaataaaggaagaatagccaatgaatttttttccaccttgatttcttcttttattttactaatttttactttgctttttttttctatttattcagttgataaattatatgacatttaaggattttttttcaactagcttttaattaatgtcctaaaaattacatcctttacatcaaactgaaattatttctttaattttttaaaggtttactgaaaatgtctgaacatttatcctctgaataattataagcaaaaattatacttgttgtattatatagcaactacacattgaatgatgattctgtttattaattgttattatttttgtgtgtgcaggtttcattggtcagtttaacagcaaatgccttgggttactcagaacttggagccatcaaatctctcaggacactaagagctctgagacctctaagagccttatctcgatttgaagggatgagggtaagaaaaatgaaagaacctgaagtattgtatatagccaaaattaaactaaattaaatttagaaaaaggaaaatctatgcatgcaaaaggaatggcaaattcttgcaaaattgctactttattgttttatctgttgcatatttacttctaggtgatatgcaagagaaataggcctctcttgaaatgatataatatcatttatctgctgtgcttatttaaatgactttatttcctaatccatcttgggagtttccttacaaatctatatacaaaaaaaagctgatgcattattaaagtactatgtgtaatgatataatggtaatctaaagtaaattctatatcaggtacttattctttgtgatgatatactgtacttaacgagttttcctgaaaataatgtgaatcacacatgtgcctaagtatgagtgttaagaaaaaaatgaaaggagttgttaaaacttttgtctgtataatgccaaagtttgcattatttgaatatattcaagattagatggttagatattaagtgttgactgaatttataaaactagtaatactaacttaaagattacatacaaatccacatcatttttataacaataaagtaaaacacttataatgaacagaaaatataattttgactcattactataggtaatttatacattaaccttaacttgcatcttattggtcagagtcacacaaaatgttattttatccttttcaaagatgcaataatcattttccatcatgcataacagattagaaattttgccattattgacttattttccatgcctttttttacggcatgaagcattagtttatagatatataatataaaaaattagttctgcttttttttaaaaaaaaatattatcaaaacaaaacactgaattgtgtgattccaatagaaaaacactgctctttcacctcctaaggtgtagttacttttatggaaactaagctgtattgtagacttccatttgcactttgtagattgtttatagccttatgttctcttctcaagtcttattataaatgtcactttgtaagaacgtaggacttgtcttcgatttccctaacatatatgaaaactttgtcctcattatcgacaactcagaacaatataatacaagtagtcctcttttatttctcacagagagcctcaaattttcaccaaaatgttaacagaaattatctctggggtgtataagaattaagtctgttttccaattaaatgtcactttgttttgtttcagactggcagtttcagttctggagaaaaaaaatgtcatttgtgtacattctacttgaaaacatgttgcctgaatcaaaataatatattttatatggcttgtgaaatctgaacaatgctaaacatttgaaaatattataaaccttttacatttgaccatttgaaagtttattaaattcattggtcaagtgctcagatatttccatacattacacttcatttctataaaaaagctgatcttatcggtatacttttaattttctcagaaataaccatatctataattattaatcaataatgccttttatattaaaagaggttagtttttgaaacttggagttttagacataaaatccttataaatgctgatagtgatataactaatagtttaaatggtcagatttatgaatatggctctattcctcataatgacaacatacacacagcactaaaatgactaatctcttcaatacgtgtttggcattgtagagtcaaaataacgttataattgattctattttttatacttctagtgtttggatattttattttgtaaaaatataatcatgaatgatggtgaggttggatataagaatgatgattatgattgggaagtgagatttgaacatgctcagaaactctcatttaattctttgccctagcagcataaaatcacaatagctgcgtcaaagcgtaactcaggcactcattttatttttgttgttctgttattttttcaaagcatgtgcttttatgcaacattactgaataaagcatgttgtacagtgcttgataagaagttagaaagtaacaaataaattatcatcacgttgcactttgtgttttgcatgttttatgcacatttctggctgacagcttttaaacatttattgtatttcaaatttccagtccaaatttttcaacttgtaaaattaaactgagtgaattgatgtcgtgaatatctagggtaaaataaaatttgtgtttaaatttgtatttttaatttcctaacctaggaaatcttaaataccttctttttcaaaagaactcaagtcttaatggatagggaaacagacggagagcatcatgaacaaaaagtaacaccaaatgttctgtcatatcagatttctaactaataacaaactatatatttctattttgtataggataatcttgctccaacttggatggggtggagcgctggttcctcccctgagccctttattatgggtactgtattaccccttttgctacctttaatccttgcactgtgacttatgtgtagtggggtgagggagggattgggaagggtactattattgcaccacagtagggaaaatacattatttacatcctaatcccctcttttcaattgtcttaaatttcatttgaaaaaaaaaaaaacctttatgaatttaccctctgtggattttaaccccaatggttgatatctttattaagtttcattgaatatgatttagttatgtgtatatggagttatccatctttggggagattactggattggtgagggcgggggaccctggtgtagaatgattatgtgaaaaaacaatttaacttgttaagctcatgatactgtttgaggcatacagcccctgctgtttagtacattggtctgggtcctgaaaattaccagttagataccatcagttgattattgatatgtatgagcagatactagggtgcaatatttcaggtttcataagactggtattgattgtgaccactctcattttttattgtgtaagttcatatggggttattttcaaaatgttaacaaggcaaaaatatattaagaaatagttgaataagcacatgtgaattgtgttgtaaacaaaaagttagaataaaaaaatccacttatttgaattatgcagaatagaatacatacctagaaataaaacaaaaacgtcttatcatgagtattaagataaaatttaaggcataaactcacttcttagaataagtaactcccaactaactttctaggattttaaaacataacacagtgaaaacatacataaacataactctacattttatttattcttaaagtttaagtgtattatacaagaagaagagtttatattcgagagacagaaaaagtcagaatttttgtttggatcaccaatatatcatagcttacaaaaaaactgtcttaattaaaacccacaacataatttttttagatttttaagaaagattctattattcttctttatacttaaaaatggatgattcctactttgcccacttttatttttattcacatagattttctttatttctattagagaagcactagaattcatgaatagtgttgatttgaagttcaaagtaattaattcagataaaaagacatttctgcatgtatgaaaatttctaatgtgaatttgcatatttaattatcaatccttcatttagtgtagacttatttttaaaaatgcaggtaatgaaccagaaatagaattggttgtgctagagtagagaaactttatttgatgattgttttgaaaaaaaagcttctgagaagaaacaacctctagtacagtattaattcattaagatagctcctttctcagacatttcctttcatgtagcctgaaagttcaatttgaaatttgttctttccaatttattcagactaattctgcctactttcttccccccataagaaccaattactgcagctttattgagactgaaaaaagttaatacacctccttctttgctgaaccaaggaatggcttggaactcttgggaaaagacaatcttttctatgatctttcattgtctaatttaatacatcataaatatgactatagctttgtataataaactccccaatactgtgccagatgttttctaagataaagttattttatgttcacaaaaaaaataaaacttttctctgggccaaatgtatgccaactttgcaaatcatatcctgaagtgcactgctgcagagtacatgcttgcgtcataaattccatagagttcgctttaactctaaatcaatccccagtttcaaagtaaacctctcaaacatattacctaagcacaaacttctccctgtgctcagttccttaattattctcatcccatattcagaaataacatttaaaaattatgctttgatcaataaatactaatctaaactttgcttcattaacccattcatttttgtcaaccattattttattcctatattcaaagctctctggtatgttcttatattcaagacactcaaggccctggaagattcacgaacatatgtttgcatcttaaatttttagaaaatcttacaatctgtcaggattacactgaactctagtacagagtaatatgggtaccagataagtgggagcaactcttccacgtagactggaaacagcactaaatgctatttataggctactttctgaacttaacttgttttaacctcatttttctcatatgccaaatgagaacgcaatactgaattatctgtacagttctgttcagtactagaattctgattcttgaattcaaaggggaaaacattcctctttattttggaggctaaactgggggacaaagttaggctccatgaaagaagtgctatttgaactaaagcctttaagaggggagagtatttcagaagaggagctattagacaaggaatttcaatgtaaatggcatctcaatcacctggcaattatattagcacacggttattatattaattgaagtggcatgaagtatagatgaccagggaagttaaaactggaaatatagattgtggagtgatgtgaataccaaggtaagaaaaatatttgttagttaccagagagccaataaataactttcaagtgggacttggggaagattaattcatcttacatagattaaatgaaggagaaggttaggagacagatgacagtgcaagtatgaaataacagagggcagttctaggtggtgactgtgagaatggaaaagaggtggcaaagctgagaaacgtttcaaagaaaaaatgtgagacaggtaatgtgaaaagaaaatcgagaaataggtatagataatcagtgttctgctcatactctaaattgggtgttgaaggcaaaatacgtattttaattagtactctgtgtatacacactagaaacagcattgtaatctggatagtggacaaaatattcagaaaagaagggaaatagtaacttgatttcaatttccaaatctctaatctgaaagaaatctaattctattcatccatttaaaataaattatataacgagaatttatgaagtccattgtattaatgcagacagtcagatgagataaggcaaagtgtcacgtgtcagcttggtagttgcatcggccacatcatttggttctgcctggataactcaaccaaattaatttttcatactcatcccctccacctttgtcattactggtattcttattttctttggcccacttatcacactgttttatgttccccagaaggcctagagttctttacaggctttaaacagggatcagaagtataagaaattggctcatgtatttttttttcagacaggcagttaaaaaaaattgttctaaaaatacactggcatcaaatggcaaatagaagatgttttgacgactacttccattggatcagactgacaagaataatacaagcacataggtggaattaaacttagctattaatgtccaagtttgaggcagctgccccttataagcattttagggtctgtttttagcttccctcttagccactcctgtgcagctccagtgggaggtatggaggaaaaagcaaggaagccatccctatgttgtttccaaacatgaacactcaagatttttaactagtggtccagaagtaaagagggggaaaacatccttctatagaaaaaaaaaaaagtagataataattgaacacagaacttcatgtgatcacatcagatttgagaactatgtatggcatccctctttttcttattttcctaagaaatgatttctattatgtttcatttgaaataagttttttgaattaaactcagtaaatgaaacaactgacatgactggagcttgaaataaacgatgtgatgatctaatgaaatacataatgcaaattgtcttgcttcttatgcaaaaattattagtcatagcaatgcatgaataattaaagacaattatattaggtatttaataatattttttatatttatcatctgaatttttaagttattttaaaaatatattggtcaaatcaactcaggtccaaatgttttagttttgttctttaatatattgcctttttaaaatgagttaaacttctgtataggctttttaacttttctttattctgataacacaattctgacttcatctggcagcaagttcctctgattttccttttcctttaaccttttaatgcttctccctcccttttttttaaaaacatttttgtttcatttcttggttatattgcctatagttgttttcctaagtgtattgcttaagaaaaaaaaatgaattttaagatttttttgaaccttgcttttacatatcctagaataaatagcattgatagaaaaaaagaatggaaagaccagagattactaggggaattttttttctttattaacagataagaattctgacttttctttttttccatttgtgtattaggtggttgtgaatgcccttttaggagcaattccatccatcatgaatgtgcttctggtttgtcttatattctggctaattttcagcatcatgggcgtaaatttgtttgctggcaaattctaccactgtattaacaccacaactggtgacaggtttgacatcgaagacgtgaataatcatactgattgcctaaaactaatagaaagaaatgagactgctcgatggaaaaatgtgaaagtaaactttgataatgtaggatttgggtatctctctttgcttcaagttgtaagtgaacactattttctctgaatatttttattgtttggaataataacaaaataatgacatacatctattatttagttcctaagaaaaagtatatatttctttctatttaaaaaatttcaatttgttagtacaagtttatgagcccagatgggtgaaaactttattacatgtaaggactgcagatatagtcagtagtgaccagaccaaacaaagacctctttgtcttttttcttgtattttctttgtttctatattgctctttctatataaacaagtaaattaataaatcagtaactttgccattttttattgtgattagaaggcttgtttccctgatcagctaccaaaacggaatacacttaacagatagatcatcttccaaaacacatacacttaatacacctaattggattgtaattaattggtagggattaactgctgctgagttctattatttggatcaaagtttggggaatgacatttaggttttagaattagaaccaggcatagcggtgggtgccactgcactccagcctgggcaacaaagagtgaaactccatctaaaaaaaaaaaaaaaaaaaaaaaaaaagagagagaattatacctggaagcaactagaaacaaaaatgaagcaaaagcagctgttgtcttatctcaaatgacctttcagcaccattatttaagtctattttgtcctaaatattaatgttttcactactgggtctctaagactgggtctccaagaaaaatagtttataatttatatttaaaaaaggtagccctttaaacattttcatttgattctgcttctagctgcagcagcaccacaacaaagcagggaataaaataagagtccagattatttgaaaactcagcttaaaaaaaaaagactgtacaatttctttcttcccttgtggttctacagtgtctttagggcagaaatcaatttttgctcaccaaggttatgatttcaactgttcaaccagaagactaactaagcaaacaaaccaacactggtcaaaacccttttgcagctcttccagaggtgtcaactatgattactttacaaattcttcccacctttttgttggaaattcttatttctcttcttaacatttttgatctactctgaataatattcatgcaattaaaatagagattttttaaatctggtaagaacgggtggggcatggtggctcatgcctgtaatcctagctctttgggaggccaaagctggaggattgcttgaggccaggagatctagaccagtggaggcaacatagtgagaccttgtctctaaagacaaataaaaacaaaagttaaaaaaaatctagcaagaatgctttctttaaaaattgtcgacacatgatgatatttatttgggcacttattctaacccttaactaatgaccatacttgtaaatatcactaaagcaaccacctcctccataaatttgaggaaagaaaaattaaaaattttaagcaatcctttaaaatgtaagcaattctgaaaatacagtgatggtcctgcacaaagctattaaataaattctgccaccaaaaaaaaaaaaaaccctctaaaatactgcttcacatttggcttttatagaatcacctctctattgattagtaagtcattgaaatggtcccttgaatcacttttttgtttctataccaagtgtgtaatggaattgttctatcattgacctaagccactgacatatttaacacatctctctctctttcatatacaaaagccttgtactttctagctaggaatcattactttcttttcactgctgtcacccacacccttgcttagcttttgtctcatgaaatccaccacctcacaagggttagcgttatcagaacaaagatatattgtgatacagacgctaaaggctttgctaacctccctcactagctaagggataatccttttaggcccacaggactcaaaattcatgccccaggacaagtaacaaattactgtaagttgttagcctgagtatccttcatcctgtgagtgccaagtgtctgctgtactattgttcacatttcttattcatattaacttattatcttcaagaatttcagaaagaaaatagaatagggggttatttctaaatgttttgatgcaaaattcttaaaaggattgtatttctaaatgttttgctccaaaattcttaaaaggatagttgcaaccctgcctttatgtatcctggtactatccttacattgttacaataaagagaaatcttaaattttcaatcactttgatcaccctgcagataaattttagcagatgatccttagatctaagttgtaattatttggctgatagagctattgacccatgtgttggcatttgtaagactttctaaaaagtgctccagcaaattttaatactgctttaaatatcatgacaccatgaactctaaagaattgaaaagtgcttgtgagttggttatcaaggggaggatatatcaaatggccattttgttcaatatgtgttctagaaatgaaaagccatactaaaatactgtcttggtccaaaatctgtgtaaaatttgttttgaaatgtctttcaaaaatattcccttttgaaaattatatcagtaagaatatttattaaacatcaggtctaaattatttttactccaaagtaaaacatgcatgtccttcttaataggccacattcaaaggatggatggatataatgtatgcagcagttgattccagaaatgtaagtattccttgtattctaagtctttttacaatattgatcaggtggtaaaattaatcgaataaagcataaacgaccaaatgaaatgattctatcttgatttaaaatatttgggaaaaagtgtgacaggtaaatattcaagcatagcaatgtttatcagaaagatcttactaagataattcaacacatgaattattttgaaaaccaaagtaacaaattcatgtatttagtaactaacaaatattttccttttaaatattttctattttgtttcctatttatccacacattatataattagtagtaattttagtgtgcgggaccaaatttgaagaaatatatgatttctatcattagttgaaatgtatagtcaccctccatattagacagcatgaaaagttatggatattgttctgtcagccttagattactgtgatgatttctttcaaataatcctattttaaaccatataaaagaatgtttttatatgatttttgcattcataaattgactggagcctttactaatgttgcaatcacttctgtgaccaacagattcctttaagtgtatatcaccaaaatataaacctattttatttgatttcagcctctttcaggctccaagacctaaactgaaattcatgctcattccaactttgctcttcaaaactttgtaagatgtagtattttctatcaaccttcatctttctattctcaagtcccatctgtttagtttatcatcataaagaataacctctgtccctgcagtcttcaacctgatagagtttgatgttatctttcttgaagtgcatttcaaatagctttagttttatgttgaatatcattttgataacctccagagttgttttatttcactttgtcacttatattttgttttgtgtgtttagttggtttttaactttgttgcttttagaaggacatgaatctgttaaaaaactatagtgacctttcagtccattactaaattataagtaatagcccatttgttttaagcacaatctaggaattaaataatcaactgaggatttataaaatggactgtccatctatgtctacttaatctgaaaaattcaataactgttactttagggtaaagtgccaaacatctgaatgaacaactcatttcttatttgctacattatttcatgcatacatgaatgactgtttctaaacctagcctgtagatatttacagttttaaattttttattaataattttaaaattactaaaattcagtaccttaaaagcttgcaaatttagcacattactgttcaaatggaagaatattatttgtatttatagttataaaaatagattttagaatgtcataatagccatatttttcacatgaaaacatccctaaaggccaatttcagggatgttttttagaggtagttgattcagaaaaaaaaaaaatgctgacatattagtaagaataattttttctattgttatgaaaaagcaccagtgacatttccagcactaaaatgtatggtaatattttacaaaatattcccctttggtaggtggaactccagcctaagtatgaagaaagtctgtacatgtatctttactttgttattttcatcatctttgggtccttcttcaccttgaacctgtttattggtgtcatcatagataatttcaaccagcagaaaaagaagataagtatttctaatattttctctcccactgagatagaaaattattccttggagtgttttctctgccaaatgagtacttgaatttagaaacaaaatgggagtatatattataactgatttttccttcctcttcctctgtcattcactatccatatatttccggctatagaaagctaagaataactgtgttccacactcttgttcataggttcataaagtttttcctcctcttattcattatcaagaaacattttctatcttttaaaaaataataattagaataaaactagaaagcaaccgaatatgcctctttcccaaaagcaatttgttactttatccctacaactacccactcccccttgaaaatatattttccaactaattctttgcaataaattaggcactggatgtaagcttcttctagtgtttatttttacgcttttttctgtcattgatttcttttatatattcccatttctttctccaagatatttaaatacaagctatccgtttcagtcttgaattgtatgactattatttatcatttataaggctcatttgattgtcccaattacctatgtacattatagaacatatggaaagtaaataaatatcatcacttggaagtaactgctgccattcacattttgttttctgttcagagtatttctgcacatactcttattgttgtactttttatctataattataaattccactttagacttaacataagtattttctcattttgttaagtcttcatatatgcattatcataatttacttattcattccccagtaggttgataatttagattgtttttaatctttaatgatttaaatagtaccttgttgaaagttttgtacaaaaaaaaagagagagggacagaaaataaggctttaattatttcctgagaataaattcccacaatgaagtattttactcccctagagtaatataactactcaaactcccaatatcagtgtatgaacacccatgccaccgttccctcactgtcaccaaacattctgtttttgaatatttgatatttaataggtgaaaactgtatttaattttaatttttatgacttttataaccttaattgttatgacttttatgtattttattacatttgaacatgttcttaaatgctcattggccatttgtatttcttcctttatgtactgttgcttcatctcacttgttcagtaggtttgctttttgtataatgaatgagtgctttcttagactacagaacattctcccctcaattcccttttcttattaccagtagtattcttaagtcaatatcaggctactctatttcacttacttgccagtgttccaatcttctatccctactggtctgtcccatacttactatgctatgagctctgatttatcccctaaatctctcactaactcatccagttttctttttatccctttcctccaattcttgacagagttagagtgacttttttaatgagtaactccaaactgtcttgcagtatacatcctctaactctttgctacatttaaataagaaaattattgcctttaacatcataaaggtagtatgtatagtataaggtaccaagtatttattatctcagtgaaccaaatttcgccactcactaagcataaggtcttgggtaaaatacttaacctttttgagatttgggggtgtttgtcttcataagataataataataaagtcaattttgaattatttagggaattaaatattatcatacctaaagagtacaattttttttacattttaaatcccagatataattatactaatcagttgaattttgtatttctttttttagccatccattttctattttaacattgaaaaaaatgtacaaaaggacacagttttaaccagtttgatttttcttttctatactttggaggtcaagacatctttatgacagaagaacagaagaaatactataatgcaatgaaaaaattaggatcgaaaaaaccgcaaaagcctatacctcgaccaggagtaagaagtatcaaatgatatgggggaaaaatacaaaaacaaaaacttgcatgcttgtctcacaaaaaagaaagtagctaacatttccagtagaaaaaatttctttcacttgtagagcatcatctaaaagtgatgtttgtatcttttatgataatggtaacaacaaaaaaaattaaagaccaaaaaagaacaagaagaaatagaagatacacccttgacttcaagagatttagaagcaccccattacaatccatattaattggccaatggacacatagacaatgtgatgtgcacaagagaaagttaatcacacaactcaagaatggttgccaagtaatatcagggaaagaagtaaaccttgggatggggctgtaagaaatgcaatttcctaatattttaagaaatgaagtgttgagtgaaataacaccttacttctattttatttttcactagagatactaagtgttttaaaggaggaaagaattccagtatctactattcatatgtatggctatagagttaggtattactaatgtctgcagaagtcagggtcagtaattacagtttatgatgataaataacaatactcatgcttccatgatgaaataaacaaattgctatgaaaatgtacagctattatcccacactataaatatttttatgatgatgatctgagaggtttcagtaattcctagggtgcatcaaggaaaaaactactagcaaatattcatattgtgatgattgaatattgccttcctgagaatgatgagaaatatatactttctccattaaaatttagcactaagagtagaaatgaaacaacaatttaggaaaaatataagttggaaaattccctcagaattcctcagtggcccaaagaaataagcctgcagatggccttcagtgactagcagtggcagaaatgggaagcagaatcacagatcaacgacaaagaacgtgaagttttttttgacataaacatataggaaatgtcattctggtctcattatccttgtgcagtttcaggattctgtgtctgacaatgttagccaaggctatttggtagaagaatatgagtattgccatatgtggtatttaaatgcataatgttatagatgtgtcttggaaattccaaattctccttaacaattatttgagaatacaacaagtgaaatattaatagtactatattttaaaatggatgtatggtccagctgatcattggaaagtcttgaaaaaaaaattaaatgggtttcttaccttttcataatcttaaaatgttgatatgtgttgcatacctctggaagaagtatacagtgttgaatgtttcttttgtttgtttgtttgtttgtttgtttgtttttatcagaaaccttctttggataagggattgttattctgagaaatacacattagtaaatggcaatttaaataactaaattttaacaattaatatgctataaatcattcttacaaaaatcagggccaatgactactttgcaagaaactagaaagtcaattaatgcagaaagtacttaatgctaatgcacatgagaaaactcctttgttgttaaaagcatttctatttctctacagaacaaatttcaaggaatggtctttgacttcgtaaccagacaagtttttgacataagcatcatgattctcatctgtcttaacatggtcacaatgatggtggaaacagatgaccagagtgaatatgtgactaccattttgtcacgcatcaatctggtgttcattgtgctatttactggagagtgtgtactgaaactcatctctctacgccattattattttaccattggatggaatatttttgattttgtggttgtcattctctccattgtaggtaagaaatatttaaagttcttaaattcagttaaataaaagtgaaagctgaaacaatcaagattagattcaagatcatcccagcaatcagagataatcactgtaaatattttgatacattttatccaagtgtgtttgtttttttaacaaaatgtctcctactatatgtcagtattgtttcttattctatccatttagaacaatatacttagtgtaaatgtagtaaaacctcattcatttgaactagaactgtgctattaactaaaataaaaatgtttttgacatgttgagattgaagaaccaatatagtatctagatggttctgttaacaagactagaaatgtagtctggtactcacgaaaattgctttagagaatagacatggagtcaccagcatatagatattagtggaaagtggtttcaagataaggaaaagtattgcataaaaagagaataaagacaaggactaaacattagcaaatgcatatagtaggttctctgcaagtgtcatgtagagattttctagactaccttaaaaatgggtttatcataatgatgcacaagggaaataaggtggcatgggacatcatcagtactatacttcaaagcctggaacacataactagcctcatgagcaatagctcatttcattagacaaaactaaagctctagtaaagtaaaaagcatctgtctgtgggcctattcattcttccctaaacaggatgatatgattgggtcaatattttactatccaaaacgaggcacctgtgttggacagattttcatgccactcccctctctgaagaaactggccttatatccagctcattgtatatagcctttgattcccactaattataatccttggttataactagtgtggctaaggtataaaagttgtattctcacacgtctccttctctctctctctctctcacacacacacacacacacacacacacacactcttacacttcgtcttttcagaatgaggcatttaaacttgaaggcatttagtttcttgagctcttctttttaactttacaagtattgtttttatctaaaaagcaaatggagagagaagctgaaaataagaagactgagattacagtgttaggtacaggagaccaaaaagaattgaaatacaacattaagtacaggatactaaaaagagcatcaacctgggatcctttcagaaatgcaccagaacatacataaatgagtatataaaaatattagagtggaatttaagtaagtaccaagatcatggggagatgaaagtagcatcaaaagctaccaatactttcagatggaaaaggagtaaatagagaatttagaatatggcaatttcagaaaaagtcactgtatacatataaacttgtacctatactgttgggctgctactgttcggccaaatgtgcatttttaacttattttctttttaaattctgacttgggactttacataaactaaaagtagtttataaacatctcttaaagataaaaaaaagtactataatccttataattgaaattattgctgaatttcaaaattaagatttataatatattatgtacaattatatatatattatatatagttgtcatatttaatataactgggttcaggactctgaaccttaccttggagctttagaagaaacatatgtttattttaacgcatgatttcttcactggttggtattctcattgtttattcataggtatgtttcttgccgagctgatagaaaagtatttcgtgtcccctaccctgttccgagtgatccgtcttgctaggattggccgaatcctacgtctgatcaaaggagcaaaggggatccgcacgctgctctttgctttgatgatgtcccttcctgcgttgtttaacatcggcctcctactcttcctagtcatgttcatctacgccatctttgggatgtccaactttgcctatgttaagagggaagttgggatcgatgacatgttcaactttgagacctttggcaacagcatgatctgcctattccaaattacaacctctgctggctgggatggattgctagcacccattctcaacagtaagccacccgactgtgaccctaataaagttaaccctggaagctcagttaagggagactgtgggaacccatctgttggaattttcttttttgtcagttacatcatcatatccttcctggttgtggtgaacatgtacatcgcggtcatcctggagaacttcagtgttgctactgaagaaagtgcagagcctctgagtgaggatgactttgagatgttctatgaggtttgggagaagtttgatcccgatgcaactcagttcatggaatttgaaaaattatctcagtttgcagctgcgcttgaaccgcctctcaatctgccacaaccaaacaaactccagctcattgccatggatttgcccatggtgagtggtgaccggatccactgtcttgatatcttatttgcttttacaaagcgggttctaggagagagtggagagatggatgctctacgaatacagatggaagagcgattcatggcttccaatccttccaaggtctcctatcagccaatcactactactttaaaacgaaaacaagaggaagtatctgctgtcattattcagcgtgcttacagacgccaccttttaaagcgaactgtaaaacaagcttcctttacgtacaataaaaacaaaatcaaaggtggggctaatcttcttataaaagaagacatgataattgacagaataaatgaaaactctattacagaaaaaactgatctgaccatgtccactgcagcttgtccaccttcctatgaccgggtgacaaagccaattgtggaaaaacatgagcaagaaggcaaagatgaaaaagccaaagggaaataaatgaaaataaataaaaataattgggtgacaaattgtttacagcctgtgaaggtgatgtatttttatcaacaggactcctttaggaggtcaatgccaaactgactgtttttacacaaatctccttaaggtcagtgcctacaataagacagtgaccccttgtcagcaaactgtgactctgtgtaaaggggagatgaccttgacaggaggttactgttctcactaccagctgacactgctgaagataagatgcacaatggctagtcagactgtagggaccagtttcaaggggtgcaaacctgtgattttggggttgtttaacatgaaacactttagtgtagtaattgtatccactgtttgcatttcaactgccacatttgtcacatttttatggaatctgttagtggattcatctttttgttaatccatgtgtttattatatgtgactatttttgtaaacgaagtttctgttgagaaataggctaaggacctctataacaggtatgccacctggggggtatggcaaccacatggccctcccagctacacaaagtcgtggtttgcatgagggcatgctgcacttagagatcatgcatgagaaaaagtcacaagaaaaacaaattcttaaatttcaccatatttctgggaggggtaattgggtgataagtggaggtgctttgttgatcttgttttgcgaaatccagcccctagaccaagtagattatttgtgggtaggccagtaaatcttagcaggtgcaaacttcattcaaatgtttggagtcataaatgttatgtttctttttgttgtattaaaaaaaaaacctgaatagtgaatattgcccctcaccctccaccgccagaagactgaattgaccaaaattactctttataaatttctgctttttcctgcactttgtttagccatcttcggctctcagcaaggttgacactgtatatgttaatgaaatgctatttattatgtaaatagtcattttaccctgtggtgcacgtttgagcaaacaaataatgacctaagcacagtatttattgcatcaaatatgtaccacaagaaatgtagagtgcaagctttacacaggtaataaaatgtattctgtaccatttatagatagtttggatgctatcaatgcatgtttatattaccatgctgctgtatctggtttctctcactgctcagaatctcatttatgagaaaccatatgtcagtggtaaagtcaaggaaattgttcaacagatctcatttatttaagtcattaagcaatagtttgcagcactttaacagctttttggttatttttacattttaagtggataacatatggtatatagccagactgtacagacatgtttaaaaaaacacactgcttaacctattaaatatgtgtttagaattttataagcaaatataaatactgtaaaaagtcactttattttatttttcagcattatgtacataaatatgaagaggaaattatcttcaggttgatatcacaatcacttttcttactttctgtccatagtactttttcatgaaagaaatttgctaaataagacatgaaaacaagactgggtagttgtagatttctgctttttaaattacatttgctaattttagattatttcacaattttaaggagcaaaataggttcacgattcatatccaaattatgctttgcaattggaaaagggtttaaaattttatttatatttctggtagtacctgcactaactgaattgaaggtagtgcttatgttatttttgttctttttttctgacttcggtttatgttttcatttctttggagtaatgctgctctagattgttctaaatagaatgtgggcttcataatttttttttccacaaaaacagagtagtcaacttatatagtcaattacatcaggacattttgtgtttcttacagaagcaaaccataggctcctcttttccttaaaactacttagataaactgtattcgtgaactgcatgctggaaaatgctactattatgctaaataatgctaaccaacatttaaaatgtgcaaaactaataaagattacattttttatttta

SEQ ID NO: 2 - DNA, 33620 bp, Homo sapiens
tctcggctgccgctgctgccgttggctcttattctcctcctcctcctcctctctcctcctctctgcttctctctgctcctctctcctcctctctcctcctcctcctcctccacctcctcctccttctccccctctttctccccctctttctctcttctttctcccccgtccccccgccccctccccccaggcctgatgagcaggtctcgagcctccatccatcgggggagcatccccgcgatgtcctatgcccccttcagaggtacgtggtggggggagggggagggccatatggggggcaacagggggaggggcagggggcgggggagagtcggggccgagggaagggagcggctgaaatggagggagaggggaggaccgggaaggcaggggtgggagcaaccgggaaggagggattggaggccagagggataggggtagataagggatggaggggccaggaaatgggccttgaaagggggctgaagggaaaatgatgaaggggaaagaaagcgccagaaaggggtgggaaggtagaaggattgggttggggaaaaagctgcagaaataatttgggggtgggagctgagtgatgaggaaaacatcaaggaaatagagggacagagtcttgggagaggggctaggaaggagaaatgaaaacataggggtgaaaagagaagccaagaagatgtggggggataatttggtgggggactcagagtatggtaaggggcggaaaaagagaggaggatggagggagagaaggggccagatggagagagagggaggcagtggggggtggggggatggagggtccagatggagggaagagagaagagagagggaacggtgggggaggggagaccagggcagggggagggccaaattatgtgtgcttgggggggtggcagtacaagtaagatgaaatgatgggagtaggggacaggttaggatcctgccccagactctgaccctcttaaaggctcttgaccagtaaaatgtaacctctggggtcttaatgctgtcttcacttcatcacttttacccccttcccccacccctccaatccttatttccattccccctccctcctctgctgtccatcacctatatctttccccccatatggtgtccgttccttatatgagtcccccttctgtccttcccctatatcagtcccctctctggtgttcattgcctctctcttatctcttttctatgtggtcgctcccttatatctctatcacttctttactagtccgtcttgaccccttctcatagcctccgcattaggtctgcctcctttgctctgacacatgtccagtcgagcccttcaggtgtattcccttgcccctgggcatttaccatcatttctgcctccttttctatctactcctattatttgtctcccagaccattccttgtcaccacaagtctgtgcctacccactttcccttaatacctcaactcttattatcatttctcttttcttgtctcctctacttattggggtgttggagatttggggtacaaagacacaggttttgatgattagaacaagggatccccatctcagcccttgagggatttctcatcctagtaaaaatttcccgtttctcagccatgttgctctgcctcttgcatctgcctcccagaatcattcttcaccaagtccagacagtatgtgtgtgtgtgtttctagagttgttcctaagttccctgctgccaggagaaagatgccctctgaagtctaacccgcctcccttggctgcagcctgaaccagccctttccccaaatgcttatgtgtatcaacagatttctcctctgggtataccaagtgtctaagtgcggtgggcatgttgcctgcaatgtctgtagtttcagaggctaggtattggtgatctctgtatctagagaacattagttagtctctgagatgggttgagatagagtttcaaagtatgtggtttctaaatggtggacattctgagggttcatcgctcactgtgatctggaggttgggtaaatttgagagacatatttatagacagaaaagggctgaatttgcaaaactctgctactcagtgcattctgttggaatgaagctcaaagaccagttctcctgcagtatactcatggttatcccataaaggtgacagagtttgatcttttttccatctaaaatctgataccttaagcctaatttctagctctttgctgtcgccaatgtgacatctctcttacttcaatagggcctgtgtggcattggggtttaaaggagaggcagtttgcagggagagcggcatggcaagaacaacagagctggggaaggaggaccctggtctcatctcagccataggcgacacttggtctactgttctctcttctcaaagttttgttcccatctccagctcttgtctttggaggcccctctgtgtcaccaggcctggatattccattctttccccctgacatctttcttcctcaagctcctcactgtgccttgagaaggctcctgacctatggagtggcttccatcctgtccactgagactaggtggggtgaggtggtgggggcagtgttgaatctctgggcactgaatgggagaagagataaatttggtctctacttgtccaaacaagggcatatttcccaccttctgccctggggcctccacagccagatgccgacaaaagccatcttctccttaccaccagaagaaccagaactttccctaaaggatgagcagggttgaactaggggaggagggcacagaggagggaagagttgggaggggaggccctctcatgtctctgactgtgaacaggtaagctccccgacttcttcttttctagatatttagccctcagaatctcatgatcccaatgttcctacacacacaccccatccttctttcccacagccatgtagctttcctcatactcttttatagaggggtggtgccaccttccaagtccttgtcttctgcagctatttggatgccttcctctacccagatatctgacaccaacttctctgtttttctcctgccaattttgcggcacctctaccttattttcctgaagtagatggagagctccttcatctttctctgcccccaaacgtgtaccttctctgtcatataattcccatccctgaacctctgcatttcttcccccaagtctccagagccttctgtgatgtgatcctctcctcttttcccctttgtataaatgcttgtcttgtgttcctttagagttgccaggtgtctcactttcaactgtgatctcctgaaggccggtagggtccccttctcactttgtggactctcttcttgccattttaggcctctgcttccaaatgcatagagcctcccttactgtttctgtgtgtctctgtcctccagatgtacggggaccctctatgcaccgaacccaatacgttcattccccgtatgatcgtcctggttggaaccctcggttctgcatcatctcggggaaccagctgctcatgctggatgaggatgaggtgagtgtggtgagaaggctgggaaaacgcatgtgggagaatggggagagtcctcattagtgaaggggagagagacacaaagaaggcagacaaagaagaaacatttgcaaatggcaggagggtggccattgagacttgggttggagtgtgacaagaggggtagtcattctctcatcttgggcagggagtctttgagggttatgagctgtgttggggaggagatgtggttctgaagatttcgggggtggggaggctcctgttttcacactgtccatattgtaggataggttagaatggggaaggggaactgaagggtttggagaaggggtgaagacatggaaggccctcccaaccaaagcaatcctcaggacccctctctgctttgcccactgagcaagactcccagtcctttctccatcagggggcagagtgcaagaagagaaattgcaggacgcagagaaaaggcaggggatagaggaggttttaggtagctggaggatactgggaaagaagactgaggtcagtggatcttggcatgatggggtgaagactgggagagtgattgagatcaaggtttagagagacactgagagggcttctgcaagggagtggttggacatcaggaaggaatataagggaggggaactgggagtatgtggagttatctaaaggagtacaagtggagtaggggcagggactagccagagtaaaggagatgaaacggacagaggcctcttatgggaggtggtggccaggtatggagatctgagagccagggaagtgtgggttctgatttgggagctgggtcagcaggagtgtccattggaggaaatagaggataaaaactggaatggtgccccacaagtgtgagtcagggaatgggggtgatttgggggacaagctttaaaaaatggtagggtagcctggaaaaccaaacgtggtgagagatggaccctgaaagttattgggaatggtgtgatgaggaagggttagaatttgagtcagggctaactagagtgtcaagggacctatgggggcaggtgagagtgtggagagatggctgggtagacagcttccaggccacagagtaaagtagaggtgttaaggagaggatatggtgactttgaaaggagaggtggcttggggagtctaagttttggacaccattgggagacatttgagtgactgtggtcaaacccctagatcaaggtttggagtctgtaggagaaatgggggaaactggaacccagagtggggactgttatagggatgaagagggaagacaatggattggggtaatgaaggaatgacagagatagggacagactgaagggaccagtggccagcaagttgaggggcaataggaatggccggtctggagcaggaagggcgtgtgtgtgggaggaggagtagatagaattgggaaaatgagcagcctgaacagacgcagggagttggaattggatgggtggtggaactggggctgggggatagtgaggggtctgttcctgtggctctttgtagaggtggaggagactgcaggggtggaggtgtatggaggtagggatggaggtggacagggggagctgggtgtgaagcttagggaaaggtgatggctgaggggaagaagggaactgagagatgctgggtcgggtgatggaaggagatgaaaggtgggggaaggtgaccaggccctctggcgggaggggaggttgggtcccagtctggccgcaagccgggccgtgggagggagacaagctgtggatcctgattataaatgcagcttctgctacccccgtgacaggctcggagggagagaagggggtaagggaggtgggaggttgggaggaaagcagggagaatggaggaactgaaggtcaagggaaaactggattcaggaagtagctaacttctgaggagttgcagaagagctgagtagggtttgggagaattctccggaaggtgtttcaagacaaatggagggagaaaagagggtgggacggcaaagaatgagagagagagactgggggagagaagggagagatccagtcaccaagtgtggaggggccggggcagaaaaagtgggcaggcttagggggaaaaggaggcccgcccttcctgggaggaggcggaggggggaagagggaggggaggggcggcgtgggccagggaggtctgacacacccccacctcccctagatacaccccctactgatccgggaccggaggagcgagtccagtcgcaacaaactgctgagacgcacagtctccgtgccggtggaggggcggccccacggcgagcatggtacggcggccgagcaggctctcatgacccggacaggcgcggggagagggctgaagatggaccgggctggcggggcgggggcgtcggggagcggcgggagctggccgggggcgggagaaggcggagacaaagtcttgcttcccgaggggagatggcgccctcctctggaaggtggagcgggacaggggctgtgggtgagaggcccctgtgggtcctcgctcggcttcgctccctttctcctctccagcagtgaagtttgactattttcctggtgcttgtaaaaatagtctccttagatctttagcttccagtccgtgtgttcctgcccctgcccctcccagcccctggtctgggatcttggaaagaatgacctagttcctgccctccccccagacctcttccccacccctatgctcctgattcttcttccggaccttcagtccttgaggtctccttttattaccccctgttttctcctctcatcagctgcttctattttctgcaattgtatcaccctttctctttcctccctgatttctcttattttctgtacccctcttgattaccccgtccctcccctctgctcccggcgaaagtccatcagactcccatctcatctcctttctgtctgtagagctatctgcgcggtctgtctctccaactctctccctctctccatctgtctcttcccctccctccccctttctgcccccccaaccccctctttagtcatttaaaaaaagatttttgtcttcctgagaagttcgcttaaaaggtttccatgggaacagtgaggggagatgaaggcagagaacagagatctgcagccaaggtgcagagagacgccctcagcccccggaaaccccctcgtcactgcccccttccacttcatttcccttcccggacctagcgatccaggttccccattcctccaacccccaggtgacccctttttcccaccagctccccctcccttcaggaattcaagctaccagtttctctcccttagagagccagtgacctgtccccatcctttggctccttccagccttctgataggtccaggccctactagccttgtgggccggtttggggaccttgggtgggtgggtgggtggtcagggatgtgtgtcattgtcatggaaaccccataccatcggggtgtgtgggtagcacatctctgtgaggcaaagtcaggtggtggtggagtgtatacagagaatgtgtgtgatgtctgtcacatctgtgtgtatatgtatatgtgtgtatgtcatgttcatgtctggggaagatgtgtgtgtttgtgtgcatgtgtgtacacctgcgtttccaggccagaatggtcacatgctcacagagcatgtttatcatgtgtcctgtggttggcagatctgcccacttattccccatctttctccttatcctgagtcctcagggtctaggggtctctggcgggggtctcccgtgtgttttgggtggggacaccgtgtgtgtttggagttgaggtggcatgtggaggttgctgtattggggttcagtaggggctgggaggggttccaggggcatatgtatttggggggagggcttagtgaaagttgatgggggtgaacgtttagggtcttcaggcagacatggaatgtgtaaagggcatggaggatgtgcagtggacataggggtcgttgggaccttggggacttggcaatgccaaggtgtttgctgaggctgtggactctccagcccgggagaggtcgccggacctttgaggggcattggaatcctgggctcctcctctgctgggtggagccgcgaaccctcgttctctccgcggttttgtgtgtgtgggggggtcctgctcaggaggggatggtgggtggcctggtttgttttgggggtccccttgcccccctcccccgtctctctcgcgctgtctccgggcgacagggctcgtgacagaggcggccacggcagcagcggtcgcctagcaacggcggcggggcccgggcaacggcggcagcggcgggagcggcggcggagggagccgttcccgcggccgtcaccgcgcggccgtcccggccgtcccgggccccgccgccgcccccaccgcgccgggcggcgcgagccgggccgtaccgccccctctccctccgcaccccgcccttcccccgcgcaggggcggggcccctcccccaccggggacacccctggcccccccggggggcggtgcgaggtaagggcggggccgggcggactaggagcgcgcgtagaggggggggcgccgcgcgcgtggggcgggggcgcgcgtgtgcgtgggcgcggggaggggggtggggaagccgcggtggcggcggcggcggcggcagctgctccctccgcatgttctcgctgcatcttccgagtggggggagttatggtaaccggagggggacagcggaggacgggagggtcggggaccggcctcgtgcggacagggtcttgagcacgcgggggcggccggtgtgtgtgggatcttggagcccctggtggaaggggcagcccgtgtgtccgcgtgtgtgttcgtgcccatgctcgtgtctcctgtgtgtcggtgccatgtgcacacgggggcccagttcctcgtgcacacatgtgcagccatccttgtgcaagtgtgtcctgtcttatcttgcctctgcctgtttcctgcctagggggctgttgggccagccacgggcttgtggggcagtccgcggccttgctggtccatgtcacctctgaccctgagcatgcatatccctggctggggctcacctcctgtcaggcttctgtgtgtgggaatgtgtggccctatgagcaggattttctgtgtccctggtggcaggtgtgtgtctttgcatgtgtgttccagcactggcctgagtatctgtgtcaatcccagcatgggtgtccagggcgtgtctggatgtgggtggtgtggctggggggagtaagtgtgtgaatgtgttccttggaattctactgtgtatgaaacacctttgggctgggcaggtgtaagccctgcttggtcagtaagtggggacagaaaagcttaaaaagggaagaaatggggtaaagaggaaaagtggggaggggataggagagaaggaatgagagaggcttgaagaagagagcagagagcagcaggccagggagaaagaatagctggagaatgggaatgtgggagaaagccaagccagacttagaagagagaacaggggataagagcttaagatggggaactggatagagatggtgggagaagaaggggtctgggagctggggaggcagtggggaggagagagtcaggccttctggtaaagtgatctctgaaagaagaaagggaagaagatgggagaaggcactggattcttgtaggccttgcaggatcaggcttggttttggatcagggaaggccactcaggcatacgggctggctcacagtgaggcctgtcatagcagggactgtcattagaggttcatatccccagcacagagctctgtctcccatttctctgctctgtgtccaaccctgttcttcgcccttctctggcaacctccctcctctggctccccttgagagctgccagctgggtgtggagaggaagaaaggccaaagggaaggttagggatttggagggcagggggagattctgtgggtgatggcaagattagagatgttggaggggcaggagtccaagcccttgctgtgtgtgtgtgagtgccattgtgtgtgtacacagggtgtgtacatgtgtgggtgtgtgcacaatgcctgtgttacgggtttgtgtaggtggctgttatgtgtgtgcatgcgtgtatacatcgtgcaggcatgggacatggagacccaggatcacagtttgtgcttttcaggtttgctgtgtgtgtgtgtacacgggtgtgtgttgttttctctgtacatgtcactgcatgcagcattaataacaggatgttctgtgtttctgtcactctgccccccctttcctctgtgtttctgctattcttttcctgcggcaacaaaagtgtttaataagcatatgtgtatgtggcctctgtgtacctgtgacttatgagtgagttcatggatcttagttcttggtaatatgtgtaaggttatattacttccaagaaccaagcaagccaattagcaaatttgttcttctgttaatgctttagttccaaagcggaattttaatgcatttaaagttagactttatgcctttattagatgagcttgcacatgaaaataatggctgagctcggttccctgaaatgagagtgaggcagccatacctgagaaatgcagaaaaaatgttactagggaagagatatcctgaaccattggatgcattgcttagtgtgtaccagaaggataattaacacatttgctcctggtttttctttactctggtggcaatctcggatgcctgtgttagagtgagagaagggctgggggaggaaagggggttgtcctgagacagagtggatgtggttgtacttttcacgtgaatgaaaggatgtttgtgcttctgagatatggggatacctttctgtggtcaggatcatggtgtactcaagcatgtatttcaggggttaaactggaattcccctgcatggggatatgtgtgtcttagggttataggtccatttctgtagtgtgctgtccacatgattgcccaagagacttgggccacaaagtccacaccagcagctctcatgtgggtcactgggttcaagtatgtactcccttgttgcagagctcacatatgtcaaagcatgtatcctgtggggtgtgtgggcctcagggtctcagaatgtggatccgtgctatgcccgtgctcacagttgtctgtatgtctcaaaagcacatagatccccagttatttttctgtattgtggttctcatatacacgtacctccatagctcagtatatgtttctgtactatacacctgttcctgagggagtgatagggttctcgtgtcatggggtccacatttttgtatgcaaacctcctaacacctgggttttacaggtaaagggaagctgaggactgattctagggcagtttgcaggcaatttgcaattctggaagcagacagtgaaaatataattgtggtcctcccttgttctgttctggaacctagagggttaacaggcagctcttccggtccacccccctccttccagcctgtagcttcttgttgccgtggagatggtggccccgccccgatgcagcacctgcccccccattggctgcagtggtgactgtggggctgaggggggagcccaggcctgggcagccattctggagctggagccggagcttggcatccccccacttacattctcttccagcccctcggcccctctaaattcccttgcagccgagcctcagcttcctttttcagcgcttgccatccctctaggctcttggcagactgagctgcatccgcattcacctcccctcctcctcctttccctatccttacttgggagtcccgagaacccccactgtccatccttcctgctccctgcccattcccctgcattctttgcttttcccctccccccaccaaccttctgagcccctgccactgcagtgcacgtggaaccggctccttctcccttccccccacctgccccttccttggattttctgtccccagcttctccccctgctactcttcacaggtctcttccaagacctccccctccagtccagggagggggtcatgggaggcagccctggccctccagacagacaggggttccaggaggtggggggcaggtggaagatgtgcccaccagggggaagaggaaagcctgcctatgggcaatgacctttaacccatctttccccccagctagccccttctggggtgggtgggcaccagggacctagcctccctggatctttggtgtccttcattactggggttttactgaccctctcagccatgctcccctgctgactgccagccccagtcatgggcctaaggcctcccaccccatccccctcagggggctcctgctcaggttccttgccccctccttcccgctgccagcctctccgccgtcgctgctcttcctgctgctttccggggggtaggtgaggccggagctgaggggcagagggaggtgggggcatgcactggggtcaggggtgggaacctgggttaacagcttcccttctggccccctccccaacttcccttctggccatttcctcccctccagaataccacttgggtcgctcgaggaggaagagtgtcccaggggggaagcagtacagcatggagggtgcccctgctgcgcccttccggccctcggtgagtggtgcctaccagatgtggctcagttgggccccctcccctccagccccaactggggccctaggagtctgagaaagagggcaggagggggagagagggagtgagagtgagaaaaagagtgtgtgtctgtgtgtgtctccccacctctttggtttcccccttcttggctctgcccccctgcttctgagaccagccctcccaccttctccaagctgtgtgtgtgtgtatatgtgtgtgtgtgtgtgcttgcactgtacccgtgggagcaaggaagacaaactggtattagggttcctatccccctttcctcgcctctggagacttcccttttccccatcccactttcatccaggggctctctaccagctgagggatgagtaggtagaactgaccctgccccaacccaccccatccccatttcccccccagcaaggcttcctgagccgacggctaaaaagctccatcaaacgaacgaagtcacaacccaaacttgaccggaccagcagctttcgccagatcctgcctcgcttccgaagtgctgaccatgaccggtacaggggctggagcatgtgggatgagattgatgtaatgtagggtctcctgtgtgagatgcagagggagggggttatctgtgtgcaaaggttgaaggattcaactcaagttggttgggggatgtcatggcacaggggacagaacagaaaagaactagaatagggatctgtgagcagcaggagaggggtagggtggcagagagaagacagacagacaggctggaaagggaatgaaggtgaagccaaggagggactcctcagggactcctcaggccaagaaggatgggctctagcccaggatcaaaggagctgtacaggaggagagtgaccctggaggaatgtttaaggaatgcagggaaggggttggtaggtgagtgagcaataggctgtaggtggaagggtgtcagggaaggtcaggaaatacaggggcagcaggttggagtggggctgggggtggctgaatgaatggatgatggctagggctcaaggacctcatcagtgagggaagagacagtatagagcatggcagagaaggggaggctgggacaggtgtgcagggtgacagaatgggaagcaacccatggactgaggcatgaagaagcagccagcggagaagtccagaaggcactgtccctgagaccaggctgaaggagacctccactgtttgcctttgttgcctgccatttggggttcctctctgggtttccccctcacccagtcactccccagggagaaccatgccctccctttcccccatgtctggccacccccaggattgggcaggtagggaggttgggataaagtgagtcacacctttccctgcccccctcccatgttgccagagctggatttggggccggcagggggtgagggcatggtattcctggccgcgggggcgggggggggggtccgggggccgggggagcgtcgcgctgacggcagccagagcctgcgatgacggggctgctataaataacttcttggaggctcccacacccaagctcccctcccgctttcccactgctctctactcttcatcccctgcccatctccataccgcttttgtattgctatcctacccctcattattccatgcccctagccccctttatcttctgccctcctgcagtgatttttttgcattccatcccctcttagccctcacctcggttctcccggccatctctccagttggccttcctcctcttctcctgtcctctgtcttgctgcacatacctttgtctccccctttcttcttcttgccctacctcctcttcttccctagtccgtgtattctgtcttttatcctctttgagctcttttctgcccacagctttctcctatttcttatgcttttccctcactctttcccctgcttctgctaaaacttgtcctcttatgctgtgttcattcattctttgaatcattaaatgtttatcaggcactagccgtgtgccaggcccaggctagacatatctcttctctgtgccttcacttctttacttccactttttcctttatactgaggctctggtttctggggttacctggaggtactacctagaagtgccccaggcccactttgttctctccttttttttttttcttttctgccatggtccatttctgggttgagatatttctagatgtccccagtcctcgcaatcccttaggtgtgagatggtgggagtttcttttttttcctttttttttttttaaatagaaatagggtctcactgtgttgcccagactggtcttgaactcctgggctcaagtgaccctcccacctcggcctttgaaatgttgggattacaggtgtgagccaccaggcccaggtggagcaggggagttccttaaaggattctgatttttctcacatccctcacgtccttcctgataggcagggtttctttctgtgtctgtttgggaagggtgttcagggggccttctctccaagtctccatcctggaacagactgatgatgcagggtacctatgtgtctaagaagagtaggggggccgggcgcggtggctcatgcctgtaatcccagcactttgggaggctgaatcacttgaggtcaggagtttgagaccagcctgaccaacagggtgaaaccccgtctcagctaaaaatacaaaaaaaaaaaagaaaaaaaaattagctgggtgtgctgaggcaggagagacgcttgagcccaggaggcagaagttgcagcaagccgagatcacaccactgtactccagcctgggcgacagagcaagactgtctcaaaaaaaaaaaaaaaaaaaaaaaaggaagagtgggaagccctgatcccttcctctcctgaacctcctgcctgccagggcccggctgatgcaaagctttaaggagtcacactctcatgagtccttgctgagtcctagcagtgcagctgaggcattggagctcaacttggatgaagattccattatcaagccagtgcacagctccatcctgggccaggagttctgttttgaggtactgggtctggtgggctggggagggccaaaggacaggggtgatggaaggtggggggcagagaggtctagagaaagtggcacaggtggggacatcaaggaaacagaaacttctgggactggaggaaagggtaggccagggaggaagagaaggtagcagagtctcctcccctctgtagccctttccctcaactccacactcctttctaggtaacaacttcatcaggaacaaaatgctttgcctgtcggtctgcggccgaaagagacaaatggattgagaatctgcagcgggcagtaaagcccaacaaggtattggggaataaaggggacacaacctgtgcagggcaaaggttgcaccaacacgggaagctgggggcctagggaggaaagtgagttaaaggaggagaggcttggggaaggagaggattgaggtacagtgtatctggacaagcagggggagacccccattattctgagtcccccatttcttttcgctttctgtactgctaccctgccttacgatctctttccctgccatagaagtcatagacttacagagttgatggggctctggaaattctttagtctagcttccctgcaggcaggaatgcttcactaataccccgcaggacacatcaaatacacttagccaagtttctgtaccttggtttcctctctaagacagagggaactggtggcaatgggttggattaaatgatctctaaggtccctttggcacataaattctatgagtctgttcttcccaaaacttcatgcttccagttctgtcagctattctctgtatcccagtttctagcaagcttacagtcctagtcacactcctctggggggaactcttgtgtcttgatgtccttaaagaactcaacccaagatgctgacatgatctgacctatgcagagtacaaacaccatgttccctttcaacacactgcaatatcacctgagccttaccattagcttgtgctcaattgtatccccccaggcccttactgattcttttttttttttttttgagacagagtctcactctgtcacccaggctggagtgcagtggcgtgatcttggctcactgcaacctccgcctcctgggtttaagcaattcctgtgcctcagcctccccagtagctgggattacaggcatgcaccaccacacccgactaatttttgtatttttagtagagacgaggtttcaccatgttggccaggctagtctcaaactcctgacctcaggttgtctgcctgcctcagcctcccaaagtgctaggattacaggcatgagccaccacatctggccaagctttacccattctatatgcaattcttttttcacaatttctgatagtctctgcaggactttccagttcccttcaaattctacattaatatttttggcttgttattccagcttttgaaatctttccaatactgtttgtgttgtctagtgtatgtctacgcttctacagtagcttcctggggctgctataacaaactgctacaaactgggtcacgtaaaacaacagaaatttattctctcacagttcaggaggctggaagtccaaaagcaaggtatcagcagggccacgctctctttgatgctgtagcagggaatccttccttgcctcttcctagcttccggaggttgccagcagtccttggcattcctgggcttataactgcatccgtctaatttctgcctccatcttcatgtagctggcttccttctgtgtgtctctgtatcctgtatctctgtgtctccaaatctccctctccatataaagacaccagtttttataaggtgggttaagggtccactctaattcagtatggcctcttttttttgagatggaatatcgctcttgtttcccaggcttggagtgcaatggcatgagctcagctcactgcaacctccgccttccaggttcaagtgattctcctgcctcagcctcctgagtagctgggattacaggcacgtgccactatgcccagctaatttgtttttgtatttttattagagacggggtttcactatgttggccaggctggctcgaactcctgacctcaggcaatccacccacctcggcctcccaaagtgctgggattacaggaatgagataccatggctggcctcttcttagtttgattacatttgcagggatcctgtttccaaataagatcacattcacaggttcagggtagacatgagttttggtgggatactattcaacccagtacaccgtctcaccttatgattgctgtctgtatcccactttcttactgtctctcctcttttggtgtctctctgtcccttccccctttaacatcatgcccaccccaccatgccaggacaacagccgccgggtagacaatgtgctaaagctgtggatcatagaggcccgggagctgccccccaagaagcggtactactgtgagctctgcctggatgacatgctgtatgcacgcaccacctccaagccccgctctgcctctggggacaccgtcttctggggcgagcacttcgagtttaacaacctgccggctgtccgtgccctgcggctgcatctgtaccgtgactcagacaaaaagcgcaagaaggacaaggcaggctatgtcggcctggtgactgtgccagtggccaccctggctgggcgccacttcacagagcagtggtaccctgtaaccctgccaacaggcagtgggggatctgggggcatgggttcgggagggggagggggctcggggggtggctcagggggcaagggcaaaggaggttgcccggctgtgcggctgaaagcacgttaccagacaatgagcatcttgcccatggagctatataaagagtttgcagagtatgtcaccaaccattatcggatgctgtgtgcagtcttggagcccgccctgaatgtcaaaggcaaggaggaggttgccagtgcactagttcacatcctgcagagtacaggcaaggccaaggtgagtgttgtgccctcagggaaaggtgacttgggaatgggcacttgcttgggggttagtgaggacagggcaaattcacgagattgggttgtgcagaggctgacacttggattttcctgggcctcaggacttcctttcagacatggccatgtctgaggtagaccggttcatggaacgggagcacctcatattccgcgagaacacgcttgccactaaagccatagaagagtatatgagactgattggtcagaaatacctcaaggatgccattggtatggcccacactcaggccctcttcttcccaaacctgccagatgtccaccccagaccccaagtccacccttccacagcttgatacttcctaacccagagtcctaggactccagcctccaacacctgattctgaaatttccccaaccctggccacccccttccctgcccttggaaagtgtgaccacaccctcttgtgcccccaccccccaggagaattcatccgtgctctgtatgaatctgaggaaaactgcgaggtagaccctatcaagtgcacagcatccagtttggcagagcaccaggccaacctgcgaatgtgctgtgagttggccctgtgcaaggtggtcaactcccactggtgagactgggaacgctgggctggggggccagggtcgggggaattatgtgttcatctgttcatctatctgtccatcctcaaagaggactgagcaccatttatgggcaaagcattgttctaggcgctatagagcaaacaggtgaaagaggcctggtccctgccctcagagggcctccaccagaatggggacaaattagaagaaaaaaaaaaaaagccacagagccataatggtgtgtaagtgctgagtaagggtccccccaacctctgtgtgacataaggtcagagagaaggcagagctttgagataagtggggaagaggtgcccccttgggtaggctttgaagactggtttaggttctgatatatggacatagttggcaagaaagacatttcagaagaaggctgtgagaaaggcacatgtgtgatggtgaaaaggcccaggagttttcaggggacattaaagtaggttagtagcaattacatcaggtttagtggagcatgtgcctcataatggggagtggcgggagagatgtctgggcaggaagattagctttagaaactggaaggcctcaaggagtctgaggtcattggtaggccttgggatgccattaaaggtgtcagaaatattgtgatttagaagattaatccataggctgggcacggtggctcacacctgtaataccagcactttgggaggctgaggcgggcagaccacctgaggtcaggagtttgagaccaggctgaccaacatggagaaaccctgtctctactaaaaatacaaaattagccagatgtggtggcacatgcctgtaatcccagctattcgggaggctaaggcaggagaatcacttgaatctgggaggtggaggttgtagtgagccgagatcacacgattgcactctagcctgggcaacaagagtgaaactccatctcaaaaaaaaaaaattaatccataagtagagtgtatgtagtagagtagagggatgtatgttgggggatgactggaatagagccagctgggggctcggaggcatgaaagtcagatcctgaatcagaacagtgacagaagttaggaaggagctactggaaggaccctctcgggaaaggatcagtaggaattgtcagcttattggaaaggagggagcatgtctgtggggagtcacggatgactcaagaggccatgaggctggtggttgggagaccggtggcctcattgacaaccaggaaagtcaggaggaggagccagttggaggtgtgggggcgatggtgagctctgctttacaccagccgagtttaaggtgtcagtgggacattgaagtggaactgggaggtgcggggagtgagctctgagccattccagggactggggatcatgcctggggcacctccatccccatttccctggaatccagaagagttggggggtccgagctccctgtacctcaagtgaccctccatctctctcccatctctgtctctccctggtgtctgtttttcttctcctcctctccttgtctctctcccacacccctccatctctctcccacgtgtctctcccctcaccttctctccccctccatttctctctccctaatctgtctgttccctctgccatggcccccttcttcaagcagcctcccatcttgctcctgcggtccctccttccctgtctctctcacccctgtttccacaccctcacctcctaccacccccctcagcatgttccctggaagctgagggtctctggggctcagtcccggtctctctctttctctctctctctctctgtctccccgacccttccccccagcgtgttcccgagggagctgaaggaggtgtttgcttcgtggcggctgcgctgcgcagagcgaggccgggaggacatcgcagacaggcttatcagcgcctcactcttcctgcgcttcctctgcccagcgattatgtcgcccagtctctttgggcttatgcaggagtacccagatgagcagacctcacgaaccctcaccctcattgccaaggtcatccagaacctggccaacttttccaagtgagggaagcttcaggagtgggcagggcagggagtggcagggcagggagtggcagggctgggggtcggcaagaagggtctcctgagtccccagagatcctgagatggggaggctatgataccttgtgtgtgtgtgtatgtgtgtgtatgtgtgtgtgtgtgtgtgtgtgtgtgtatgtgacctttatcttctgcattcttggctaggtttacctcaaaggaggactttctgggcttcatgaatgagtttctggagctggaatggggttccatgcagcagtttttgtatgagatctccaatctggacacgctaaccaacagcagtagctttgagggttacatcgacttgggccgagagctctccacactgcatgccctactctgggaggtgctgccccagctcagcaaggtcagcagatcccctctttgccctatccccagatggctccagaggttcctggagcctgagaaactaccctttgaagattttttttctccccttgtttctcgaggtgtcaccactactatcccaactcaggccccctccacctgcaccctcagaggccctcttagagctgggcactgagcccccaggtaacagcctcacccttccaggaagccctcctgaagctgggtccactgccccggctcctcaacgacatcagcacagctctgaggaaccccaacatccaaaggcagccaagccgccagagtgagcggccccggcctcagcctgtggtactgcgggggccatcggctgagatgcagggctacatgatgcgggacctcaacaggtgagcaccctgggacagccaggcctgtgccctaggagcccttctcctattctagatactcctcactgggccccacatgcatctctctagggcttgaaagaagggaggaaaaagcaccaagttctcaggggagacgataaggagacaggtacagtcagtggtaggctgagagccctttacagcctgagggagtgagagatttggagctctaggaatagggctgaggctccaccaactcacggcttagttgtaagcctagagcatccctgctgcaagctctgatttgctgtccctctgcctgcccatgctagtccccaggctgaggttcagccagcatgtcatgtcagccatgtgtcaaaatgttcaaacatctcagtaatagctagtgaataagcacttcccccagcccccgaccacaaccccacagacctccccatgatccagcacttagagcagtgacagcagaagcctagcagggcctgcagcctgctccagagtcccagcctccattctgataggtggtgcccgtgcttcatttgctgctcattattttgatgatggccctgctttttcctctgcccgtgtcttcctccatgacaccatacccatcccaccattcccgcctctcctttcatttgtccacatctctctccttctctgtctgtgctcgcccctctttccatctctctccagctccatcgaccttcagtccttcatggctcgaggcctcaacaggtgaggggctctcccctcccccgccctcctctcctctcctgtctgttccctctcccactccactggccttcgccctactcctctcctctcctcctccatggacctcatctcctccatatgtgcccagccctgcccccatcccttctcttgctgcccccatctcccctcctctaggcctcacccccttcccggaggggccctgtcctttccctttactcacctgtcccctcccatcctccctgcctgccctcttcagggctgccaccgctagctctcagcccttccctctgggtcccacttttcaccccaaggcctgtgccagaccacagcaaggttcaattgctaggagccctgaccttaccttctgcttgtgtgcccccttcccttctgacagctctatggacatggctcgcctcccctccccaaccaaggaaaagccacccccaccaccgcctggtggtggtaaagacctgttctatgtaagccgtccacccctggcccgttcctcaccagcatactgcacgagcagctcggacatcacagagccagagcagaagatgctgagtgtcaacaagagtgtgtccatgctggacttacagggtgatgggcctggtggccgcctcaacagcagcagtgtttcgaacctggcggccgtaggggacctgctgcactcaagccaggcctcgctgacagcagccttggggctacggcctgcgcctgccggacgcctctcccaggggagtggctcatccatcacggcggctggcatgcgcctcagccagatgggtgtcaccacagacggtgtccctgcccagcaactgcgaatccccctctccttccagaaccctctcttccacatggctgctgatgggccaggtcccccaggcggccatggagggggcggtggccatggcccaccttcctcccatcaccaccaccaccaccatcaccaccaccgaggtggagagccccctggggacacctttgccccattccatggctatagcaagagtgaggacctctcttccggggtccccaagccccctgctgcctccatccttcatagccacagctacagtgatgagtttggaccctctggcactgacttcacccgtcggcagctttcactccaggacaacctgcagcacatgctgtcccctccccagatcaccattggtccccagaggccagccccctcagggcctggaggtgggagcggtgggggcagcggtgggggtggcgggggccagccgcctccattgcagaggggcaagtctcagcagttgacagtcagcgcagcccagaaaccccggccatccagcgggaatctattgcagtccccagagccaagttatggccccgcccgtccacggcaacagagcctcagcaaggagggcagcattgggggcagcgggggcagcggtggcggagggggtggggggctgaagccctccatcaccaagcaggtaggtgaaggcaggaggaaggcgggctgggtcacaacagggagggaagaaggagatggggggtggggttgaaacagagtctgtggcctgaagttacaatcttcttgcctccttttggccattaaacaaatgtgtatagagggcctgctatgtgccatgtgctatgccaggcactaaggatacggcactgaaccctcttagcactctcattccagaggggattaatccataagtagaatgggggtgactggaatagggccagctgggggcttggaggcatgaagatcagatcctgaatcagaacaacaggagaaattctctggcattcaactcacatctctggcattcagaggtgataaaggctacagcagggcaataggactgggactgtcgtctcctttggctgtgctgttgccctctaaatgtaccctgctttttcccaccttttctttctctgttcgccctcactgtgccttgtcccagcattctcagacaccatccacattgaaccccacaatgccagcctctgagcggacagtggcctgggtctccaacatgcctcacctgtcggctgacatcgagagtgcccacatcgagcgggaagagtacaagctcaaggagtactcaaaatcgatggatgagagccggctggatagggtacgatgggctctaccagctccaagccccagtgtttccttttacccacaggggagatctctagtcacttccaagggaaacctccagggtcagttatggtggtaagaaaaggcaaagacctgatcacctcttgagaagccttccgtccatctggggagaccagatacacacagttgttaaaagtcactttcaactctattttgtaggttatatatatcatagactatctggggatcatctattttaggcttacctccatgttcttccccaggaggaacataagccctggctcctgtgactgcttaggaaaggaaatgttactttactggcagtaggagctaataaattggatggggatggagggggttgcagctatattacaagtgatgtctggcctacccagtcactgtcccatgggcataagtgacagtcagtgggcagggaatgcatgtggtaaagtagtatgtatcagtcatgtgtgaaaagaccatccagaccctcacttggtggaggctgagggcaaagggcaccaagagctctggggctaacacagataacttagcagaaagttacttgaggaagctgttgttcctagggcctgaggaagagggcggctgcaggattaggtcatatataaagaacatatgatcctaacacggggaagtggtctttgagcataggaaatgttgggactgactcagatgggcttgaccagcaaatttaatgagaattaaaccctaatattagccccaaggcagccaccgtaggaagttaattcacatctctcctctgcatgtagaagggttggtgatatatgtatgtatcctcttcagagaatgaggaaatagtcttttgaatcatttttttttctgtgcttcagatgaggaaaccttgttgagaaaggctgtagactagcactatccaatataactttctgcagtgatgaaatgttctgtaatctgtagtgttcacatgtgtctagttgtgattcaggaactgaatttttagatctatttaattttaattttgtaatttttttgagacagggtcttgctctgtcacccaggctggagtgcagtggtgcaaacatggctcgaggcaacctccgcctcctgggctcaagacatcctcccacctcagccccctgagtagctaggactacagggtcgtgctaccatgcctggctagttttttttcttttcttttttttttttttttttttttgtagagacggggttttgccatgttgcccaggctggtctagaacttgtgagctcaagtgatctacctgcctcagccttccaaagtgctgggattacaggtgttgagccactgtgcctggcctaaattttaaatagctacatgtgggctggtggctaccatattagacagcacagctgtagactctagagccaatagggcagataaaatgactcttctgagctcttccagctctggaattcctagattctcagcctagaattcacttgtagacctcctatccttggcaccttgacagagccaaggagagggtcacatggaggacagcacctgcctttcccccgtcaattgccttttcttcctatgtctccagcatgtgttctggggcctggcttagggctgaagagtcaccctatttttaatttctgagcacagttactcaaggtgtgtttgtgagtgtaggtttctgtgtgggtcttcatgaggggccatacatagacctcagggtgtgggagtctgtgaccttgctccattttgagggaacctcagcaccatggcagggtcttctcaaaagcaggtgtgtggatatgatccacaggcagggaaggggttggggaaggcagctggatgtccctcaacatgcagtggctgtgcttggcagacagggatggaggctgggtggtgggcttggggtggggcgcccctcatagtgcggggtcgtgtgcccggcgggcaggtgaaggagtacgaggaggagattcactcactgaaagagcggctgcacatgtccaaccggaagctggaagagtatgagcggaggctgctgtcccaggaagaacaaaccagcaaaatcctgatgcagtatcaggcccgactggagcagagtgagaagaggctaaggcagcagcaggcagagaaggattcccagatcaagagcatcattggcaggtgaggggcggcctggggagggggttgtgagggagagcctgaggctggagagagcaagtgggtgagctactccgctgactcccatccccaaactcaggagcccaccaggagagcccaccactctcctccccaggaagccacccactcactcatcaccagatggagagaaaccccaacctgcttagtgcattaaatatctctttaccaaaccctgacctctcttctgatagagtagcttcggaagcccttggaaaatgtacctgttcctgtccaaccatcactgcatttgcatttaccctaggccagagctccccactagttattctcaacttaacctgtgatgttcactccaaacctaagcagggctccctagccagagtaggccctgcccttcctgggtggaccctccctctctagccttggaaaggtgttctgttagaaagggtcttttagcctgtgtatgttttcagctgctccagcaagtcctgggctccaaagagggtatcctcagcaaagaggtcaattatcttcagagtggtggggtcggggtgggggggaccctgggcgcactccaaccagagccacctccattttgatccattctaaatgtattttatgtaagatttaattagaagaaaagggcttcttgaaatattttttgaaaaccactgctctaattgatatcctttatgataaatcacctcgaggatcttcacagtgaggtgacatgggggatgcagaagccaggtcctcagccatggaaggtctggggaaggggcactgctgtcctgattgggacgatggaggcctggaggtgtctggatggtagaagtctttgaggcacagaaagctgccttagcagggaggtgtaagggttcctgggaggaaggtggagagcatgatcctgaggaacagggagtcttgcatcacggcaatggagggactctgattctaagggataaggatgcctgaggtttttccagagagctatggggttccatgggcaggctctgagcctgtgcccgccactaaccccactgaagcccgtcccttcaggctgatgctggtggaggaggagctgcgccgggaccaccccgccatggctgagccgctgccagaacccaagaagaggctgctcgacgctcaggtggaaattacaatgtcatttatcttctccgtgtcccatccccatccatcccactgtctttcgtgcactcactacaccagccacctagccccatcaccatctgtctctcatagtctgctgtttgtccactggctgctcctggcagccccctagtgaccccatcttcatcccatcgtctgtgcctttgtcactcctggcagcgtcagcccaactcctgtgccttcccatccagtcttcccactcctctctgcatctcaggaccttctctaccagaaccttggtctttctgcccctagaccccacctagttccaagaacccctgccccttctttgctcactcctattcaagccacgttgttcagcttcctctgcgctcttgggccagagggctagaagctgccgttttctggaatagagcacagggcagtatgatctgtagtttctccaggccctggccggtaccctgaaaacttggggacccatcacctctgttctcttggctccctaattttcctgtctccttggcagctcctgcatagcttcctcttcctgactcttcagatcttgaaggccttccatcctgtaacctccctttgccctcagtatttaagtccagcctccctctggcctccctcccactctggccctcagaccttcccagctgcctgctgcccagcctctcttctcacaagccagcttctaggacctcccttctgcacccttaccccttgctttcccaaaattctgctcattttcctacccatactcctctttgctctgactgctaggctccccccgcctgccatccccccaccaaggctcctgaccccatgaccccactctctcccactgcagctcctcatcaggtaattctcctggttccgctttggccacgggcggaggacacagggggaggtgactccggaccactgcaggttggtcgtgaagcccactccctccaacacctccggagcctctcccctctcactgctgccctccacacccagagaacctccacagactccagccctccgacacctgcacagatccatctcccaagacaccacccaaagagagcatttgctgctgcttcccagaactgtccaacaataccttagcaacaccaagagttgggccctagatgggcccagcacattcacaggtcacacccacttccctgcaaaacccaccccctcccagcctcctcctgactctaagccctcctcttcctctacctctccagtgtatgtctgtcaccccccatttcaccagagcgtccttaggggctgggggtgggtttgttaatggggtggaggcaatgatgggttggaggatcttggctataggggctgtgctgactgcagcaggtaggttgggtttccctcttccttccctaatcttggttctctaccctcctttccactcctcacctgattctctctcttcctcctccttatatctgtgaggcagaaggcatctgaagctcatattagcccccattgggtgggaattaggagtgggtagttaactcagggagacttgagataccctggaaaaaatgctattgagatgtcctgacattaggcagggtggatggaacaagaaggagcaagaaaggaacctcaggcagatgttaggacatggacttgatcatgtggcctgggagtttagaaatggggagagacatcctcctagatcagatcgtgggctcagtaggcatgttgattcccagggagaggtgccaggaacagcatggtaaagaatgtactcttcacagctcacatccccaggttgctgatgccactcactccccctctcctgccatcgagtggccttgccggacacatcaccctacctaaaaagccagtaaatgagaacctgtcagctatagccatcatttctgagatgcgattttctttgggattgagctgcagtgggcagtggctccttacactgtaattttaattctctgcctgcccagcctctctgtcaaagtagctggtgatctataaagatgctaaaaggcaccaggggactttgccatttaaaggactcctgcagtgaattcttttgtaaaatgaataatggcaccctaatttatccactttctaaatttgggtccatgggggtgtccagggcatgcttatgtgctgtcaccagcagacaaacagagggaatggaatctgggggttccttccctgctctcccgccatactcaggataccctaccataagtgatttcctctcactgacttgcagaaaatgtgtgagatacccagcaagctaagaaggcagttttgctgggtatctcatacccaaggctggggtttgggtgatctgagaggttagctccttgatcctaggatggaagggagagcttatatagaagcttttacttggaaggttttgtatcctaaggtcagacatagctatattaccaagcctaaatgccatgtggcccaggaaataatttggacatttgttctaaaccacttgtggtaggtattggtctctctgcaactcagccattaattagaaattagttttgagcctgaattttaaaaagccaagtgttgcccccagcccacacacacacacacggacatgtacagtacaaaccccagataattacaacagccaaagagagaaggaagtgaatttcccaaccagaagcgtagggaaattcagatggctttcttttctcccagcagaggaacagaaggcggagctaagggcaggaaccaggagttggtcaaggagctataggaggtgatgagagtagaaccaggggtaggagctggtctggtacccctcaccctctaattgggagcccagggagaaggactgaaaagaagatgggagtggaaaagaataaagccagtttctgcttcccagggatgcagagattggggcatgctgtgtctgcagaagctcctagtcatttccgccataattgtgagagagaggggcagccctcccacaagatttttcccttcccatatcacttccctgaatccccttcctttccccccagtacagttaaacctctctctaatttggaatgttatatttgagaagatggccactgtgaataagtgacaaacggaatgacagtgtctatttaatgaaatgcatgtcttcaaaatatatacagaactcgatgaacaaggctttttccactcctcagggagcatgcattaatgaatagataggattcaaaagtctgttttctggtatgggttaaatatcccctcctacagacatatttccaccactaatttgcttagtacaccttttcttcacagataaaggaaaatgcaagctcagtttttcttcagattatgaagaaattccaaatccacaggggtttggattaatgaggttttgctgtactgcctccccttattcctcaacatgaagttcccacctcggattggggatgggtgggagggggtttcaagaggaggagggtgggatgggcaaggaatatacacaggtgaagccagagaagggttaggttgggggtgcggtgggaacttgctgttttgatctggtttcctggtgtgacactctgggttaaaggcttgaaggcccctgttaggagtctaggggtgagattctcttctctctgatcccagaggacgttaacttctactgcaggtgagaaacaaaataggaggatggtggggactgtcctgggaggagggggtggtccatggcttgtggtgtgggctggctataggggaggccactgctaggggactggcatccaggcccccttgaagcgtctcaataagtccgcgctctcctttttggtgtcttgcaggagaggcagcttccccccttgggtccaacaaacccgcgtgtgacgctggccccaccgtggaatggcctggcccccccagccccaccacccccaccccggctgcagattacggagaacggcgagttccgaaacaccgcagaccactagcccacccagcatcagagaccttctcttcctttcctgtgcaccccaccctgtaacagcaccaaccaccaggattggacatcaccgaggaacagcgggattgcctccccgaatgcctccctgggaggcacactgattgcccacccccaccactgcaccatttccaggagggagagtggggaccctcagccgcccccttttccttcccattggggtgctgccctctctttgacccccagggacccttgccccaggacaccgcctaccccgtacagaccccttcactccggggtgctatccccatcctctgcctcatcgttcccctgagcactgggggacagaccctcacccccaccctgggggtgtggcacctccaaactttcaacttcagggtgatttttttagcagtaaccagagctgacaatctaactcccctccaccgccccattttggcctcccctgccccccttgttatggggaggggaccccgggtgagggggccctattaccccttgatttctcaggagcgtctgggggggctcagcacgcacaaactccttctccttctaccactcttaaatttactccctccccacccagaacccagatggggtggagggggccaccggggcagggagggggcggcaaggggggaatgggagttgtctccccttctccccacacctgatctgctctcggctggtcccagagcggggtgagggggcttatgcccccccctcccccagtgtgttgggtggggtggaattgaggttagggtgaggggtcagggtttaggagggtgtgtatgttgggaggacaggctagttgatctgtcctactctgacacacagtcccctctgccccttccttctctcttcttggtctctactcccagggggaggggggaacttactctaggaaaagccatgtctctctcccccagggtggggggacctgtgttggaggaggggtgttggggggcccccttccatgactctgtcccctgggggaggtaggacagggctgggcttccctctcatcctccccctcccaatctccttccacctccctccctcccgccagctccacgatttttcggtgtttctctgtacatagttttctggcgggataggggaggtaggatggatggggtttggggtgggtaggccatgggaggggagaagcccctccttggcaccccctcttccctgactgctgtcccctacccagccttgcccccttcatccttttgcgtttggtattgagactctcctagactctactcctctttcttttgtatggacagttccccttcagtcccatccccctacacatacacccagccggggccaaatttatacttatataaaagttgtaaatatgtgaaattttatccctgtgccctttccccacctcaggccctacccctggaccctccccaaccttccttctctcttctttggctgttgtaattatctggggtttgtactgtacatatccggggtgtgtgtgtgtgggctgggggcaacccttctgtacagagcttcctggccccctccccccccgcccctctgcttccctccccacccaccacctcaagggtagggagttgctcttcctacctgttttattttgttttctcgttctccctccccaccccactcccagccttatctatcccccctcactgtccccttttctccactcccagccccatttcctttttttctggagtgtgtggtgaaacagaaaaaaacatgtttaataaacggagattgttctttta

SEQ ID NO: 3 - DNA, 33618 bp, Homo sapiens
tctcggctgccgctgctgccgttggctcttattctcctcctcctcctcctctctcctcctctctgcttctctctgctcctctctcctcctctctcctcctcctcctcctccacctcctcctccttctccccctctttctccccctctttctctcttctttctcccccgtccccccgccccctccccccaggcctgatgagcaggtctcgagcctccatccatcgggggagcatccccgcgatgtcctatgcccccttcagaggtacgtggtggggggagggggagggccatatggggggcaacagggggaggggcagggggcgggggagagtcggggccgagggaagggagcggctgaaatggagggagaggggaggaccgggaaggcaggggtgggagcaaccgggaaggagggattggaggccagagggataggggtagataagggatggaggggccaggaaatgggccttgaaagggggctgaagggaaaatgatgaaggggaaagaaagcgccagaaaggggtgggaaggtagaaggattgggttggggaaaaagctgcagaaataatttgggggtgggagctgagtgatgaggaaaacatcaaggaaatagagggacagagtcttgggagaggggctaggaaggagaaatgaaaacataggggtgaaaagagaagccaagaagatgtggggggataatttggtgggggactcagagtatggtaaggggcggaaaaagagaggaggatggagggagagaaggggccagatggagagagagggaggcagtggggggtggggggatggagggtccagatggagggaagagagaagagagagggaacggtgggggaggggagaccagggcagggggagggccaaattatgtgtgcttgggggggtggcagtacaagtaagatgaaatgatgggagtaggggacaggttaggatcctgccccagactctgaccctcttaaaggctcttgaccagtaaaatgtaacctctggggtcttaatgctgtcttcacttcatcacttttacccccttcccccacccctccaatccttatttccattccccctccctcctctgctgtccatcacctatatctttccccccatatggtgtccgttccttatatgagtcccccttctgtccttcccctatatcagtcccctctctggtgttcattgcctctctcttatctcttttctatgtggtcgctcccttatatctctatcacttctttactagtccgtcttgaccccttctcatagcctccgcattaggtctgcctcctttgctctgacacatgtccagtcgagcccttcaggtgtattcccttgcccctgggcatttaccatcatttctgcctccttttctatctactcctattatttgtctcccagaccattccttgtcaccacaagtctgtgcctacccactttcccttaatacctcaactcttattatcatttctcttttcttgtctcctctacttattggggtgttggagatttggggtacaaatacacaggttttgatgattagaacaagggatccccatctcagcccttgagggatttctcatcctagtaaaaatttcccgtttctcagccatgttgctctgcctcttgcatctgcctcccagaatcattcttcaccaagtccagacagtatgtgtgtgtgtgtttctagagttgttcctaagttccctgctgccaggagaaagatgccctctgaagtctaacccgcctcccttggctgcagcctgaaccagccctttccccaaatgcttatgtgtatcaacagatttctcctctgggtataccaagtgtctaagtgcggtgggcatgttgcctgcaatgtctgtagtttcagaggctaggtattggtgatctctgtatctagagaacattagttagtctctgagatgggttgagatagagtttcaaagtatgtggtttctaaatggtggacattctgagggttcatcgctcactgtgatctggaggttgggtaaatttgagagacatatttatagacagaaaagggctgaatttgcaaaactctgctactcagtgcattctgttggaatgaagctcaaagaccagttctcctgcagtatactcatggttatcccataaaggtgacagagtttgatcttttttccatctaaaatctgataccttaagcctaatttctagctctttgctgtcgccaatgtgacatctctcttacttcaatagggcctgtgtggcattggggtttaaaggagaggcagtttgcagggagagcggcatggcaagaacaacagagctggggaaggaggaccctggtctcatctcagccataggcgacacttggtctactgttctctcttctcaaagttttgttcccatctccagctcttgtctttggaggcccctctgtgtcaccaggcctggatattccattctttccccctgacatctttcttcctcaagctcctcactgtgccttgagaaggctcctgacctatggagtggcttccatcctgtccactgagactaggtggggtgaggtggtgggggcagtgttgaatctctgggcactgaatgggagaagagataaatttggtctctacttgtccaaacaagggcatatttcccaccttctgccctggggcctccacagccagatgccgacaaaagccatcttctccttaccaccagaagaaccagaactttccctaaaggatgagcagggttgaactaggggaggagggcacagaggagggaagagttgggaggggaggccctctcatgtctctgactgtgaacaggtaagctccccgacttcttcttttctagatatttagccctcagaatctcatgatcccaatgttcctacacacacaccccatccttctttcccacagccatgtagctttcctcatactcttttatagaggggtggtgccaccttccaagtccttgtcttctgcagctatttggatgccttcctctacccagatatctgacaccaacttctctgtttttctcctgccaattttgcggcacctctaccttattttcctgaagtagatggagagctccttcatctttctctgcccccaaacgtgtaccttctctgtcatataattcccatccctgaacctctgcatttcttcccccaagtctccagagccttctgtgatgtgatcctctcctcttttcccctttgtataaatgcttgtcttgtgttcctttagagttgccaggtgtctcactttcaactgtgatctcctgaaggccggtagggtccccttctcactttgtggactctcttcttgccattttaggcctctgcttccaaatgcatagagcctcccttactgtttctgtgtgtctctgtcctccagatgtacggggaccctctatgcaccgaacccaatacgttcattccccgtatgatcgtcctggttggaaccctcggttctgcatcatctcggggaaccagctgctcatgctggatgaggatgaggtgagtgtggtgagaaggctgggaaaacgcatgtgggagaatggggagagtcctcattagtgaaggggagagagacacaaagaaggcagacaaagaagaaacatttgcaaatggcaggagggtggccattgagacttgggttggagtgtgacaagaggggtagtcattctctcatcttgggcagggagtctttgagggttatgagctgtgttggggaggagatgtggttctgaagatttcgggggtggggaggctcctgttttcacactgtccatattgtaggataggttagaatggggaaggggaactgaagggtttggagaaggggtgaagacatggaaggccctcccaaccaaagcaatcctcaggacccctctctgctttgcccactgagcaagactcccagtcctttctccatcagggggcagagtgcaagaagagaaattgcaggacgcagagaaaaggcaggggatagaggaggttttaggtagctggaggatactgggaaagaagactgaggtcagtggatcttggcatgatggggtgaagactgggagagtgattgagatcaaggtttagagagacactgagagggcttctgcaagggagtggttggacatcaggaaggaatataagggaggggaactgggagtatgtggagttatctaaaggagtacaagtggagtaggggcagggactagccagagtaaaggagatgaaacggacagaggcctcttatgggaggtggtggccaggtatggagatctgagagccagggaagtgtgggttctgatttgggagctgggtcagcaggagtgtccattggaggaaatagaggataaaaactggaatggtgccccacaagtgtgagtcagggaatgggggtgatttgggggacaagctttaaaaaatggtagggtagcctggaaaaccaaacgtggtgagagatggaccctgaaagttattgggaatggtgtgatgaggaagggttagaatttgagtcagggctaactagagtgtcaagggacctatgggggcaggtgagagtgtggagagatggctgggtagacagcttccaggccacagagtaaagtagaggtgttaaggagaggatatggtgactttgaaaggagaggtggcttggggagtctaagttttggacaccattgggagacatttgagtgactgtggtcaaacccctagatcaaggtttggagtctgtaggagaaatgggggaaactggaacccagagtggggactgttatagggatgaagagggaagacaatggattggggtaatgaaggaatgacagagatagggacagactgaagggaccagtggccagcaagttgaggggcaataggaatggccggtctggagcaggaagggcgtgtgtgtgggaggaggagtagatagaattgggaaaatgagcagcctgaacagacgcagggagttggaattggatgggtggtggaactggggctgggggatagtgaggggtctgttcctgtggctctttgtagaggtggaggagactgcaggggtggaggtgtatggaggtagggatggaggtggacagggggagctgggtgtgaagcttagggaaaggtgatggctgaggggaagaagggaactgagagatgctgggtcgggtgatggaaggagatgaaaggtgggggaaggtgaccaggccctctggcgggaggggaggttgggtcccagtctggccgcaagccgggccgtgggagggagacaagctgtggatcctgattataaatgcagcttctgctacccccgtgacaggctcggagggagagaagggggtaagggaggtgggaggttgggaggaaagcagggagaatggaggaactgaaggtcaagggaaaactggattcaggaagtagctaacttctgaggagttgcagaagagctgagtagggtttgggagaattctccggaaggtgtttcaagacaaatggagggagaaaagagggtgggacggcaaagaatgagagagagagactgggggagagaagggagagatccagtcaccaagtgtggaggggccggggcagaaaaagtgggcaggcttagggggaaaaggaggcccgcccttcctgggaggaggcggaggggggaagagggaggggaggggcggcgtgggccagggaggtctgacacacccccacctcccctagatacaccccctactgatccgggaccggaggagcgagtccagtcgcaacaaactgctgagacgcacagtctccgtgccggtggaggggcggccccacggcgagcatggtacggcggccgagcaggctctcatgacccggacaggcgcggggagagggctgaagatggaccgggctggcggggcgggggcgtcggggagcggcgggagctggccgggggcgggagaaggcggagacaaagtcttgcttcccgaggggagatggcgccctcctctggaaggtggagcgggacaggggctgtgggtgagaggcccctgtgggtcctcgctcggcttcgctccctttctcctctccagcagtgaagtttgactattttcctggtgcttgtaaaaatagtctccttagatctttagcttccagtccgtgtgttcctgcccctgcccctcccagcccctggtctgggatcttggaaagaatgacctagttcctgccctccccccagatctcttccccacccctatgctcctgattcttcttccggaccttcagtccttgaggtctccttttattaccccctgttttctcctctcatcagctgcttctattttctgcaattgtatcaccctttctctttcctccctgatttctcttattttctgtacccctcttgattaccccgtcgctcccctctgctcccggcgaaagtccatcagactcccatctcatctcctttctgtctgtagagctatctgcgcggtctgtctctccaactctctccctctctccatctgtctcttcccctccctccccctttctgcccccccaaccccctctttagtcatttaaaaaaagatttttgtcttcctgagaagttcgcttaaaaggtttccatgggaacagtgaggggagatgaaggcagagaacagagatctgcagccaaggtgcagagagacgccctcagcccccggaaaccccctcgtcactgcccccttccacttcatttcccttcccggacctagcgatccaggttccccattcctccaacccccaggtgacccctttttcccaccagctccccctcccttcaggaattcaagctaccagtttctctcccttagagagccagtgacctgtccccatcctttggctccttccagccttctgataggtccaggccctactagccttgtgggccggtttggggaccttgggtgggtgggtgggtggtcagggatgtgtgtcattgtcatggaaaccccataccatcggggtgtgtgggtagcacatctctgtgaggcaaagtcaggtggtggtggagtgtatacagagaatgtgtgtgatgtctgtcacatctgtgtgtatatgtatatgtgtgtatgtcatgttcatgtctggggaagatgtgtgtgtttgtgtgcatgtgtgtacacctgcgtttccaggccagaatggtcacatgctcacagagcatgtttatcatgtgtcctgtggttggcagatctgcccacttattccccatctttctccttatcctgagtcctcagggtctaggggtctctggcgggggtctcccgtgtgttttgggtggggacaccgtgtgtgtttggagttgaggtggcatgtggaggttgctgtattggggttcagtaggggctgggaggggttccaggggcatatgtatttggggggagggcttagtgaaagttgatgggggtgaacgtttagggtcttcaggcagacatggaatgtgtaaagggcatggaggatgtgcagtggacataggggtcgttgggaccttggggacttggcaatgccaaggtgtttgctgaggctgtggactctccagcccgggagaggtcgccggacctttgaggggcattggaatcctgggctcctcctctgctgggtggagccgcgaaccctcgttctctccgcggttttgtgtgtgtgggggggtcctgctcaggaggggatggtgggtggcctggtttgttttgggggtccccttgcccccctcccccgtctctctcgcgctgtctccgggcgacagggctcgtgacagaggcggccacggcagcagcggtcgcctagcaacggcggcggggcccgggcaacggcggcagcggcgggagcggcggcggagggagccgttcccgcggccgtcaccgcgcggccgtcccggccgtcccgggccccgccgccgcccccaccgcgccgggcggcgcgagccgggccgtaccgccccctctccctccgcaccccgcccttcccccgcgcaggggcggggcccctcccccaccggggacacccctggcccccccggggggcggtgcgaggtaagggcggggccgggcggactaggagcgcgcgtagaggggggggcgccgcgcgcgtggggcgggggcgcgcgtgtgcgtgggcgcggggaggggggtggggaagccgcggtggcggcggcggcggcggcagctgctccctccgcatgttctcgctgcatcttccgagtggggggagttatggtaaccggagggggacagcggaggacgggagggtcggggaccggcctcgtgcggacagggtcttgagcacgcgggggcggccggtgtgtgtgggatcttggagcccctggtggaaggggcagcccgtgtgtccgcgtgtgtgttcgtgcccatgctcgtgtctcctgtgtgtcggtgccatgtgcacacgggggcccagttcctcgtgcacacatgtgcagccagccttgtgcaagtgtgtcctgtcttatcttgcctctgcctgtttcctgcctagggggctgttgggccagccacgggcttgtggggcagtccgcggccttgctggtccatgtcacctctgaccctgagcatgcatatccctggctggggctcacctcctgtcaggcttctgtgtgtgggaatgtgtggccctatgagcaggattttctgtgtccctggtggcaggtgtgtgtctttgcatgtgtgttccagcactggcctgagtatctgtgtcaatcccagcatgggtgtccagggcgtgtctggatgtgggtggtgtggctggggggagtaagtgtgtgaatgtgttccttggaattctactgtgtatgaaacacctttgggctgggcaggtgtaagccctgcttggtcagtaagtggggacagaaaagcttaaaaagggaagaaatggggtaaagaggaaaagtggggaggggataggagagaaggaatgagagaggcttgaagaagagagcagagagcagcaggccagggagaaagaatagctggagaatgggaatgtgggagaaagccaagccagacttagaagagagaacaggggataagagcttaagatggggaactggatagagatggtgggagaagaaggggtctgggagctggggaggcagtggggaggagagagtcaggccttctggtaaagtgatctctgaaagaagaaagggaagaagatgggagaaggcactggattcttgtaggccttgcaggatcaggcttggttttggatcagggaaggccactcaggcatacgggctggctcacagtgaggcctgtcatagcagggactgtcattagaggttcatatccccagcacagagctctgtctcccatttctctgctctgtgtccaaccctgttcttcgcccttctctggcaacctccctcctctggctccccttgagagctgccagctgggtgtggagaggaagaaaggccaaagggaaggttagggatttggagggcagggggagattctgtgggtgatggcaagattagagatgttggaggggcaggagtccaagcccttgctgtgtgtgtgtgagtgccattgtgtgtgtacacagggtgtgtacatgtgtgggtgtgtgcacaatgcctgtgttacgggtttgtgtaggtggctgttatgtgtgtgcatgcgtgtatacatcgtgcaggcatgggacatggagacccaggatcacagtttgtgcttttcaggtttgctgtgtgtgtgtgtacacgggtgtgtgttgttttctctgtacatgtcactgcatgcagcattaataacaggatgttctgtgtttctgtcactctgccccccctttcctctgtgtttctgctattcttttcctgcggcaacaaaagtgtttaataagcatatgtgtatgtggcctctgtgtacctgtgacttatgagtgagttcatggatcttagttcttggtaatatgtgtaaggttatattacttccaagaaccaagcaagccaattagcaaatttgttcttctgttaatgctttagttccaaagcggaattttaatgcatttaaagttagactttatgcctttattagatgagcttgcacatgaaaataatggctgagctcggttccctgaaatgagagtgaggcagccatacctgagaaatgcagaaaaaatgttactagggaagagatatcctgaaccattggatgcattgcttagtgtgtaccagaaggataattaacacatttgctcctggtttttctttactctggtggcaatctcggatgcctgtgttagagtgagagaagggctgggggaggaaagggggttgtcctgagacagagtggatgtggttgtacttttcacgtgaatgaaaggatgtttgtgcttctgagatatggggatacctttctgtggtcaggatcatggtgtactcaagcatgtatttcaggggttaaactggaattcccctgcatggggatatgtgtgtcttagggttataggtccatttctgtagtgtgctgtccacatgattgcccaagagacttgggccacaaagtccacaccagcagctctcatgtgggtcactgggttcaagtatgtactcccttgttgcagagctcacatatgtcaaagcatgtatcctgtggggtgtgtgggcctcagggtctcagaatgtggatccgtgctatgcccgtgctcacagttgtctgtatgtctcaaaagcacatagatccccagttatttttctgtattgtggttctcatatacacgtacctccacagctcagtatatgtttctgtactatacacctgttcctgagggagtgatagggttctcgtgtcatggggtccacatttttgtatgcaaacctcctaacacctgggttttacaggtaaagggaagctgaggactgattctagggcagtttgcaggcaatttgcaattctggaagcagacagtgaaaatataattgtggtcctcccttgttctgttctggaacctagagggttaacaggcagctcttccggtccacccccctccttccagcctgtagcttcttgttgccgtggagatggtggccccgccccgatgcagcacctgcccccccattggctgcagtggtgactgtggggctgaggggggagcccaggcctgggcagccattctggagctggagccggagcttggcatccccccacttacattctcttccagcccctcggcccctctaaattcccttgcagccgagcctcagcttcctttttcagcgcttgccatccctctaggctcttggcagactgagctgcatccgcattcacctcccctcctcctcctttccctatccttacttgggagtcccgagaacccccactgtccatccttcctgctccctgcccattcccctgcattctttgcttttcccctccccccaccaaccttctgagcccctgccactgcagtgcacgtggaaccggctccttctcccttccccccacctgccccttccttggattttctgtccccagcttctccccctgctactcttcacaggtctcttccaagacctccccctccagtccagggagggggtcatgggaggcagccctggccctccagacagacaggggttccaggaggtggggggcaggtggaagatgtgcccaccagggggaagaggaaagcctgcctatgggcaatgacctttaacccatctttccccccagctagccccttctggggtgggtgggcaccagggacctagcctccctggatctttggtgtccttcattactggggttttactgaccctctcagtcatgctcccctgctgactgccagccccagtcatgggcctaaggcctcccaccccatccccctcagggggctcctgctcaggttccttgccccctccttcccgctgccagcctctccgccgtcgctgctcttcctgctgctttccggggggtaggtgaggccggagctgaggggcagagggaggtgggggcatgcactggggtcaggggtgggaacctgggttaacagcttcccttctggccccctccccaacttcccttctggccatttcctcccctccagaataccacttgggtcgctcgaggaggaagagtgtcccaggggggaagcagtacagcatggagggtgcccctgctgcgcccttccggccctcggtgagtggtgcctaccagatgtggctcagttgggccccctcccctccagccccaactggggccctaggagtctgagaaagagggcaggagggggagagagggagtgagagtgagaaaaagagtgtgtgtctgtgtgtgtctccccacctctttggtttcccccttcttggctctgcccccctgcttctgagaccagccctcccaccttctccaagctgtgtgtgtgtgtatatgtgtgtgtgtgtgtgcttgcactgtacccgtgggagcaaggaagacaaactggtattagggttcctatccccctttcctcgcctctggagacttcccttttccccatcccactttcatccaggggctctctaccagctgagggatgagtaggtagaactgaccctgccccaacccaccccatccccatttcccccccagcaaggcttcctgagccgacggctaaaaagctccatcaaacgaacgaagtcacaacccaaacttgaccggaccagcagctttcgccagatcctgcctcgcttccgaagtgctgaccatgaccggtacaggggctggagcatgtgggatgagattgatgtaatgtagggtctcctgtgtgagatgcagagggagggggttatctgtgtgcaaaggttgaaggattcaactcaagttggttgggggatgtcatggcacaggggacagaacagaaaagaactagaatagggatctgtgagcagcaggagaggggtagggtggcagagagaagacagacagacaggctggaaagggaatgaaggtgaagccaaggagggactcctcagggactcctcaggccaagaaggatgggctctagcccaggatcaaaggagctgtacaggaggagagtgaccctggaggaatgtttaaggaatgcagggaaggggttggtaggtgagtgagcaataggctgtaggtggaagggtgtcagggaaggtcaggaaatacaggggcagcaggttggagtggggctgggggtggctgaatgaatggatgatggctagggctcaaggacctcatcagtgagggaagagacagtatagagcatggcagagaaggggagggtgggacaggtgtgcagggtgacagaatgggaagcaacccatggactgaggcatgaagaagcagccagcggagaagtccagaaggcactgtccctgagaccaggctgaaggagacctccactgtttgcctttgttgcctgccatttggggttcctctctgggtttccccctcacccagtcactccccagggagaaccatgccctccctttcccccatgtctggccacccccaggattgggcaggtagggaggttgggataaagtgagtcacacctttccctgcccccctcccatgttgccagagctggatttggggccggcagggggtgagggcatggtattcctggccgcgggggcgggggggggggtccgggggccgggggagcgtcgcgctgacggcagccagagcctgcgatgacggggctgctataaataacttcttggaggctcccacacccaagctcccctcccgctttcccactgctctctactcttcatcccctgcccatctccataccgcttttgtattgctatcctacccctcattattccatgcccctagccccctttatcttctgccctcctgcagtgatttttttgcattccatcccctcttagccctcacctcggttctcccggccatctctccagttggccttcctcctcttctcctgtcctctgtcttgctgcacatacctttgtctccccctttcttcttcttgccctacctcctcttcttccctagtccctgtattctgtcttttatcctctttgagctcttttctgcccacagctttctcctatttcttatgcttttccctcactctttcccctgcttctgctaaaacttgtcctcttatgctgtgttcattcattctttgaatcattaaatgtttatcaggcactagccgtgtgccaggcccaggctagacatatctcttctctgtgccttcacttctttacttccactttttcctttatactgaggctctggtttctggggttacctggaggtactacctagaagtgccccaggcccactttgttctctccttttttttttttcttttctgccatggtccatttctgggttgagatatttctagatgtccccagtcctcgcaatcccttaggtgtgagatggtgggagtttcttttttttccttttttttttttaaatagaaatagggtctcactgtgttgcccagactggtcttgaactcctgggctcaagtgaccctcccacctcggcctttgaaatgttgggattacaggtgtgagccaccaggcccaggtggagcaggggagttccttaaaggattctgatttttctcacatccctcacgtccttcctgataggcagggtttctttctgtgtctgtttgggaagggtgttcagggggccttctctccaagtctccatcctggaacagactgatgatgcagggtacctatgtgtctaagaagagtaggggggccgggcgcggtggctcatgcctgtaatcccagcactttgggaggctgaatcacttgaggtcaggagtttgagaccagcctgaccaacagggtgaaaccccgtctcagctaaaaatacaaaaaaaaaaaagaaaaaaaaattagctgggtgtgctgaggcaggagagacgcttgagcccaggaggcagaagttgcagcaagccgagatcacaccactgtactccagcctgggcgacagagcaagactgtctcaaaaaaaaaaaaaaaaaaaaaaaaaggaagagtgggaagccctgatcccttcctctcctgaacctcctgcctgccagggcccggctgatgcaaagctttaaggagtcacactctcatgagtccttgctgagtcctagcagtgcagctgaggcattggagctcaacttggatgaagattccattatcaagccagtgcacagctccatcctgggccaggagttctgttttgaggtactgggtctggtgggctggggagggccaaaggacaggggtgatggaaggtggggggcagagaggtctagagaaagtggcacaggtggggacatcaaggaaacagaaacttctgggactggaggaaagggtaggccagggaggaagagaaggtagcagagtctcctcccctctgtagccctttccctcaactccacactcctttctaggtaacaacttcatcaggaacaaaatgctttgcctgtcggtctgcggccgaaagagacaaatggattgagaatctgcagcgggcagtaaagcccaacaaggtattggggaataaaggggacacaacctgtgtagggcaaaggttgcaccaacacgggaagctgggggcctagggaggaaagtgagttaaaggaggagaggcttggggaaggagaggattgaggtacagtgtatctggacaagcagggggagacccccattattctgagtcccccatttcttttcgctttctgtactgctaccctgccttacgatctctttccctgccatagaagtcatagacttacagagttgatggggctctggaaattctttagtctagcttccctgcaggcaggaatgcttcactaataccccgcaggacacatcaaatacacttagccaagtttctgtaccttggtttcctctctaagacagagggaactggtggcaatgggttggattaaatgatctctaaggtccctttggcacataaattctatgagtctgttcttcccaaaacttcatgcttccagttctgtcagctattctctgtatcccagtttctagcaagcttacagtcctagtcacactcctctggggggaactcttgtgtcttgatgtccttaaagaactcaacccaagatgctgacatgatctgacctatgcagagtacaaacaccatgttccctttcaacacactgcaatatcacctgagccttaccattagcttgtgctcaattgtatccccccaggcccttactgattcttttttttttttttttgagacagagtctcactctgtcacccaggctggagtgcagtggcgtgatcttggctcactgcaacctccgcctcctgggtttaagcaattcctgtgcctcagcctccccagtagctgggattacaggcatgcaccaccacacccgactaatttttgtatttttagtagagacgaggtttcaccatgttggccaggctagtctcaaactcctgacctcaggttgtctgcctgcctcagcctcccaaagtgctaggattacaggcatgagccaccacatctggccaagctttacccattctatatgcaattcttttttcacaatttctgatagtctctgcaggactttccagttcccttcaaattctacattaatatttttggcttgttattccagcttttgaaatctttccaatactgtttgtgttgtctagtgtatgtctacgcttctacagtagcttcctggggctgctataacaaactgctacaaactgggtcacgtaaaacaacagaaatttattctctcacagttcaggaggctggaagtccaaaagcaaggtatcagcagggccacgctctctttgatgctgtagcagggaatccttccttgcctcttcctagcttccggaggttgccagcagtccttggcattcctgggcttataactgcatccgtctaatttctgcctccatcttcatgtagctggcttccttctgtgtgtctctgtatcctgtatctctgtgtctccaaatctccctctccatataaagacaccagtttttataaggtgggttaagggtccactctaattcagtatggcctcttttttttgagatggaatatcgctcttgtttcccaggcttggagtgcaatggcatgagctcagctcactgcaacctccgccttccaggttcaagtgattctcctgcctcagcctcctgagtagctgggattacaggcacgtgccactatgcccagctaatttgtttttgtatttttattagagacggggtttcactatgttggccaggctggctcgaactcctgacctcaggcaatccacccacctcggcctcccaaagtgctgggattacaggaatgagataccatggctggcctcttcttagtttgattacatttgcagggatcctgtttccaaataagatcacattcacaggttcagggtagacatgagttttggtgggatactattcaacccagtacaccgtctcaccttatgattgctgtctgtatcccactttcttactgtctctcctcttttggtgtctctctgtcccttccccctttaacatcatgcccaccccaccatgccaggacaacagccgccgggtagacaatgtgctaaagctgtggatcatagaggcccgggagctgccccccaagaagcggtactactgtgagctctgcctggatgacatgctgtatgcacgcaccacctccaagccccgctctgcctctggggacaccgtcttctggggcgagcacttcgagtttaacaacctgccggctgtccgtgccctgcggctgcatctgtaccgtgactcagacaaaaagcgcaagaaggacaaggcaggctatgtcggcctggtgactgtgccagtggccaccctggctgggcgccacttcacagagcagtggtaccctgtaaccctgccaacaggcagtgggggatctgggggcatgggttcgggagggggagggggctcggggggtggctcagggggcaagggcaaaggaggttgcccggctgtgcggctgaaagcacgttaccagacaatgagcatcttgcccatggagctatataaagagtttgcagagtatgtcaccaaccattatcggatgctgtgtgcagtcttggagcccgccctgaatgtcaaaggcaaggaggaggttgccagtgcactagttcacatcctgcagagtacaggcaaggccaaggtgagtgttgtgccctcagggaaaggtgacttgggaatgggcacttgcttgggggttagtgaggacagggcaaattcacgagattgggttgtgcagaggctgacacttggattttcctgggcctcaggacttcctttcagacatggccatgtctgaggtagaccggttcatggaacgggagcacctcatattccgcgagaacacgcttgccactaaagccatagaagagtatatgagactgattggtcagaaatacctcaaggatgccattggtatggcccacactcaggccctcttcttcccaaacctgccagatgtccaccccagaccccaagtccacccttccacagcttgatacttcctaacccagagtcctaggactccagcctccaacacctgattctgaaatttccccaaccctggccacccccttccctgcccttggaaagtgtgaccacaccctcttgtgcccccaccccccaggagaattcatccgtgctctgtatgaatctgaggaaaactgcgaggtagaccctatcaagtgcacagcatccagtttggcagagcaccaggccaacctgcgaatgtgctgtgagttggccctgtgcaaggtggtcaactcccactggtgagactgggaacgctgggctggggggccagggtcgggggaattatgtgttcatctgttcatctatctgtccatcctcaaagaggactgagcaccatttatgggcaaagcattgttctaggcgctatagagcaaacaggtgaaagaggcctggtccctgccctcagagggcctccaccagaatggggacaaattagaagaaaaaaaaaaaaagccacagagccataatggtgtgtaagtgctgagtaagggtccccccaacctctgtgtgacataaggtcagagagaaggcagagctttgagataagtggggaagaggtgcccccttgggtaggctttgaagactggtttaggttctgatatatggacatagttggcaagaaagacatttcagaagaaggctgtgagaaaggcacatgtgtgatggtgaaaaggcccaggagttttcaggggacattaaagtaggttagtagcaattacatcaggtttagtggagcatgtgcctcataatggggagtggcgggagagatgtctgggcaggaagattagctttagaaactggaaggcctcaaggagtctgaggtcattggtaggccttgggatgccattaaaggtgtcagaaatattgtgatttagaagattaatccataggctgggcacggtggctcacacctgtaataccagcactttgggaggctgaggcgggcagaccacctgaggtcaggagtttgagaccaggctgaccaacatggagaaaccctgtctctactaaaaatacaaaattagccagatgtggtggcacatgcctgtaatcccagctattcgggaggctaaggcaggagaatcacttgaatctgggaggtggaggttgtagtgagccgagatcacaccattgcactctagcctgggcaacaagagtgaaactccgtctcaaaaaaaaaaaattaatccataagtagagtgtatgtagtagagtagagggatgtatgttgggggatgactggaatagagccagctgggggctcggaggcatgaaagtcagatcctgaatcagaacagtgacagaagttaggaaggagctactggaaggaccctctcgggaaaggatcagtaggaattgtcagcttattggaaaggagggagcatgtctgtggggagtcacggatgactcaagaggccatgaggctggtggttgggagaccggtggcctcattgacaaccaggaaagtcaggaggaggagccagttggaggtgtgggggcgatggtgagctctgctttacaccagccgagtttaaggtgtcagtgggacattgaagtggaactgggaggtgcggggagtgagctctgagccattccagggactggggatcatgcctggggcacctccatccccatttccctggaatccagaagagttggggggtccgagctccctgtacctcaagtgaccctccatctctctcccatctctgtctctccctggtgtctgtttttcttctcctcctctccttgtctctctcccacacccctccatctctctcccacgtgtctctcccctcaccttctctccccctccatttctctctccctaatctgtctgttccctctgccatggcccccttcttcaagcagcctcccatcttgctcctgcggtccctccttccctgtctctctcacccctgtttccacaccctcacctcctaccacccccctcagcatgttccctggaagctgagggtctctggggctcagtcccggtctctctctttctctctctctctctctgtctccccgacccttccccccagcgtgttcccgagggagctgaaggaggtgtttgcttcatggcggctgcgctgcgcagagcgaggccgggaggacatcgcagacaggcttatcagcgcctcactcttcctgcgcttcctctgcccagcgattatgtcgcccagtctctttgggcttatgcaggagtacccagatgagcagacctcacgaaccctcaccctcattgccaaggtcatccagaacctggccaacttttccaagtgagggaagcttcaggagtgggcagggcagggagtggcagggcagggagtggcagggctgggggtcggcaagaagggtctcctgagtccccagagatcctgagatggggaggctatgataccttgtgtgtgtgtgtatgtgtgtgtatgtgtgtgtgtgtgtgtgtgtgtgtgtatgtgacctttatcttctgcattcttggctaggtttacctcaaaggaggactttctgggcttcatgaatgagtttctggagctggaatggggttccatgcagcagtttttgtatgagatctccaatctggacacgctaaccaacagcagtagctttgagggttacatcgacttgggccgagagctctccacactgcatgccctactctgggaggtgctgccccagctcagcaaggtcagcagatcccctctttgccctatccccagatggctccagaggttcctggagcctgagaaactaccctttgaagattttttttctccccttgtttctcgaggtgtcaccactactatcccaactcaggccccctccacctgcaccctcagaggccctcttagagctgggcactgagcccccaggtaacagcctcacccttccaggaagccctcctgaagctgggtccactgccccggctcctcaacgacatcagcacagctctgaggaaccccaacatccaaaggcagccaagccgccagagtgagcggccccggcctcagcctgtggtactgcgggggccatcggctgagatgcagggctacatgatgcgggacctcaacaggtgagcaccctgggacagccaggcctgtgccctaggagcccttctcctattctagatactcctcactgggccccacatgcatctctctagggcttgaaagaagggaggaaaaagcaccaagttctcaggggagacgataaggagacaggtacagtcagtggtaggctgagagccctttacagcctgagggagtgagagatttggagctctaggaatagggctgaggctccaccaactcacggcttagttgtaagcctagagcatccctgctgcaagctctgatttgctgtccctctgcctgcccatgctagtccccaggctgaggttcagccagcatgtcatgtcagccatgtgtcaaaatgttcaaacatctcagtaatagctagtgaataagcacttcccccagcccccgaccacaaccccacagacctccccatgatccagcacttagagcagtgacagcagaagcctagcagggcctgcagcctgctccagagtcccagcctccattctgataggtggtgcccgtgcttcatttgctgctcattattttgatgatggccctgctttttcctctgcccgtgtcttcctccatgacaccatacccatcccaccattcccgcctctcctttcatttgtccacatctctctccttctctgtctgtgctcgcccctctttccatctctctccagctccatcgaccttcagtccttcatggctcgaggcctcaacaggtgaggggctctcccctcccccgccctcctctcctctcctgtctgttccctctcccactccactggccttcgccctactcctctcctctcctcctccatggacctcatctcctccatatgtgcccagccctgcccccatcccttctcttgctgcccccatctcccctcctctaggcctcacccccttcccggaggggccctgtcctttccctttactcacctgtcccctcccatcctccctgcctgccctcttcagggctgccaccgctagctctcagcccttccctctgggtcccacttttcaccccaaggcctgtgccagaccacagcaaggttcaattgctaggagccctgaccttaccttctgcttgtgtgcccccttcccttctgacagctctatggacatggctcgcctcccctccccaaccaaggaaaagccacccccaccaccgcctggtggtggtaaagacctgttctatgtaagccgtccacccctggcccgttcctcaccagcatactgcacgagcagctcggacatcacagagccagagcagaagatgctgagtgtcaacaagagtgtgtccatgctggacttacagggtgatgggcctggtggccgcctcaacagcagcagtgtttcgaacctggcggccgtaggggacctgctgcactcaagccaggcctcgctgacagcagccttggggctacggcctgcgcctgccggacgcctctcccaggggagtggctcatccatcacggcggctggcatgcgcctcagccagatgggtgtcaccacagacggtgtccctgcccagcaactgcgaatccccctctccttccagaaccctctcttccacatggctgctgatgggccaggtcccccaggcggccatggagggggcggtggccatggcccaccttcctcccatcaccaccaccaccaccatcaccaccaccgaggtggagagccccctggggacacctttgccccattccatggctatagcaagagtgaggacctctcttccggggtccccaagccccctgctgcctccatccttcatagccacagctacagtgatgagtttggaccctctggcactgacttcacccgtcggcagctttcactccaggacaacctgcagcacatgctgtcccctccccagatcaccattggtccccagaggccagccccctcagggcctggaggtgggagcggtgggggcagcggtgggggtggcgggggccagccgcctccattgcagaggggcaagtctcagcagttgacagtcagcgcagcccagaaaccccggccatccagcgggaatctattgcagtccccagagccaagttatggccccgcccgtccacggcaacagagcctcagcaaggagggcagcattgggggcagcgggggcagcggtggcggagggggtggggggctgaagccctccatcaccaagcaggtaggtgaaggcaggaggaaggcgggctgggtcacaacagggagggaagaaggagatggggggtggggttgaaacagagtctgtggcctgaagttacaatcttcttgcctccttttggccattaaacaaatgtgtatagagggcctgctatgtgccatgtgctatgccaggcactaaggatacggcactgaaccctcttagcactctcattccagaggggattaatccataagtagaatgggggtgactggaatagggccagctgggggcttggaggcatgaagatcagatcctgaatcagaacaacaggagaaattctctggcattcaactcacatctctggcattcagaggtgataaaggctacagcagggcaataggactgggactgtcgtctcctttggctgtgctgttgccctctaaatgtaccctgctttttcccaccttttctttctctgttcgccctcactgtgccttgtcccagcattctcagacaccatccacattgaaccccacaatgccagcctctgagcggacagtggcctgggtctccaacatgcctcacctgtcggctgacatcgagagtgcccacatcgagcgggaagagtacaagctcaaggagtactcaaaatcgatggatgagagccggctggatagggtacgatgggctctaccagctccaagccccagtgtttccttttacccacaggggagatctctagtcacttccaagggaaacctccagggtcagttatggtggtaagaaaaggcaaagacctgatcacctcttgagaagccttccgtccatctggggagaccagatacacacagttgttaaaagtcactttcaactctattttgtaggttatatatatcatagactatctggggatcatctattttaggcttacctccatgttcttccccaggaggaacataagccctggctcctgtgactgcttaggaaaggaaatgttactttactggcagtaggagctaataaattggatggggatggagggggttgcagctatattacaagtgatgtctggcctacccagtcactgtcccatgggcataagtgacagtcagtgggcagggaatgcatgtggtaaagtagtatgtatcagtcatgtgtgaaaagaccatccagaccctcacttggtggaggctgagggcaaagggcaccaagagctctggggctaacacagataacttagcagaaagttacttgaggaagctgttgttcctagggcctgaggaagagggcggctgcaggattaggtcatatataaagaacatatgatcctaacacggggaagtggtctttgagcataggaaatgttgggactgactcagatgggcttgaccagcaaatttaatgagaattaaaccctaatattagccccaaggcagccaccgtaggaagttaattcacatctctcctctgcatgtagaagggttggtgatatatgtatgtatcctcttcagagaatgaggaaatagtcttttgaatcattttttttttctgtgcttcagatgaggaaaccttgttgagaaaggctgtagactagcactatccaatataactttctgcagtgatgaaatgttctgtaatctgtagtgttcacatgtgtctagttgtgattcaggaactgaatttttagatctatttaattttaattttgtaatttttttgagacagggtcttgctctgtcacccaggctggagtgcagtggtgcaaacatggctcgaggcaacctccgcctcctgggctcaagacatcctcccacctcagccccctgagtagctaggactacagggtcgtgctaccatgcctggctagttttttttcttttttttttttttttttttttttgtagagacggggttttgccatgttgcccaggctggtctagaacttgtgagctcaagtgatctacctgcctcagccttccaaagtgctgggattacaggtgttgagccactgtgcctggcctaaattttaaatagctacatgtgggctggtggctaccatattagacagcacagctgtagactctagagccaatagggcagataaaatgactcttctgagctcttccagctctggaattcctagattctcagcctagaattcacttgtagacctcctatccttggcaccttgacagagccaaggagagggtcacatggaggacagcacctgcctttcccccgtcaattgccttttcttcctatgtctccagcatgtgttctggggcctggcttagggctgaagagtcaccctatttttaatttctgagcacagttactcaaggtgtgtttgtgagtgtaggtttctgtgtgggtcttcatgaggggccatacatagacctcagggtgtgggagtctgtgaccttgctccattttgagggaacctcagcaccatggcagggtcttctcaaaagcaggtgtgtggatatgatccacaggcagggaaggggttggggaaggcagctggatgtccctcaacatgcagtggctgtgcttggcagacagggatggaggctgggtggtgggcttggggtggggcgcccctcatagtgcggggtcgtgtgcccggcgggcaggtgaaggagtacgaggaggagattcactcactgaaagagcggctgcacatgtccaaccggaagctggaagagtatgagcggaggctgctgtcccaggaagaacaaaccagcaaaatcctgatgcagtatcaggcccgactggagcagagtgagaagaggctaaggcagcagcaggcagagaaggattcccagatcaagagcatcattggcaggtgaggggcggcctggggagggggttgtgagggagagcctgaggctggagagagcaagtgggcgagctactcctctgactcccatccccaaactcaggagcccaccaggagagcccaccactctcctccccaggaagccacccactcactcatcaccagatggagagaaaccccaacctgcttagtgcattaaatatctctttaccaaaccctgacctctcttctgatagagtagcttcggaagcccttggaaaatgtacctgttcctgtccaaccatcactgcatttgcatttaccctaggccagagctccccactagttattctcaacttaacctgtgatgttcactccaaacctaagcagggctccctagccagagtaggccctgcccttcctgggtggaccctccctctctagccttggaaaggtgttctgttagaaagggtcttttagcctgtgtatgttttcagctgctccagcaagtcctgggctccaaagagggtatcctcagcaaagaggtcaattatcttcagagtggtggggtcggggtgggggggaccctgggcgcactccaaccagagccacctccattttgatccattctaaatgtattttatgtaagatttaattagaagaaaagggcttcttgaaatattttttgaaaaccactgctctaattgatatcctttatgataaatcacctcgaggatcttcacagtgaggtgacatgggggatgcagaagccaggtcctcagccatggaaggtctggggaaggggcactgctgtcctgattgggacgatggaggcctggaggtgtctggatggtagaagtctttgaggcacagaaagctgccttagcagggaggtgtaagggttcctgggaggaaggtggagagcatgatcctgaggaacagggagtcttgcatcacggcaatggagggactctgattctaagggataaggatgcctgaggtttttccagagagctatggggttccatgggcaggctctgagcctgtgcccgccactaaccccactgaagcccgtcccttcaggctgatgctggtggaggaggagctgcgccgggaccaccccgccatggctgagccgctgccagaacccaagaagaggctgctcgacgctcaggtggaaattacaatgtcatttatcttctccgtgtcccatccccatccatcccactgtctttcgtgcactcactacaccagccacctagccccatcaccatctgtctctcatagtctgctgtttgtccactggctgctcctggcagccccctagtgaccccatcttcatcccatcgtctgtgcctttgtcactcctggcagcgtcagcccaactcctgtgccttcccatccagtcttcccactcctctctgcatctcaggaccttctctaccagaaccttggtctttctgcccctagaccccacctagttccaagaacccctgccccttctttgctcactcctattcaagccacgttgttcagcttcctctgcgctcttgggccagagggctagaagctgctgttttctggaatagagcacagggcagtatgatctgtagtttctccaggccctggccggtaccctgaaaacttggggacccatcacctctgttctcttggctccctaattttcctgtctccttggcagctcctgcatagcttcctcttcctgactcttcagatcttgaaggccttccatcctgtaacctccctttgccctcagtatttaagtccagcctccctctggcctccctcccactctggccctcagaccttcccagctgcctgctgcccagcctctcttctcacaagccagcttctaggacctcccttctgcacccttaccccttgctttcccaaaattctgctcattttcctacccatactcctctttgctctgactgctaggctccccccgcctgccatccccccaccaaggctcctgaccccatgaccccactctctcccactgcagctcctcatcaggtaattctcctggttccgctttggccacgggcggaggacacagggggaggtgactccggaccactgcaggttggtcgtgaagcccactccctccaacacctccggagcctctcccctctcactgctgccctccacacccagagaacctccacagactccagccctccgacacctgcacagatccatctcccaagacaccacccaaagagagcatttgctgctgcttcccagaactgtccaacaataccttagcaacaccaagagttgggccctagatgggcccagcacattcacaggtcacacccacttccctgcaaaacccaccccctcccagcctcctcctgactctaagccctcctcttcctctacctctccagtgtatgtctgtcaccccccatttcaccagagcgtccttaggggctgggggtgggtttgttaatggggtggaggcaatgatgggttggaggatcttggctataggggctgtgctgactgcagcaggtaggttgggtttccctcttccttccctaatcttggttctctaccctcctttccactcctcacctgattctctctcttcctcctccttatatctgtgaggcagaaggcatctgaagctcatattagcccccattgggtgggaattaggagtgggtagttaactcagggagacttgagataccctggaaaaaatgctattgagatgtcctgacattaggcagggtggatggaacaagaaggagcaagaaaggaacctcaggcagatgttaggacatggacttgatcatgtggcctgggagtttagaaatggggagagacatcctcctagatcagatcgtgggctcagtaggcatgttgattcccagggagaggtgccaggaacagcatggtaaagaatgtactcttcacagctcacatccccaggttgctgatgccactcactccccctctcctgccatcgagtggccttgccggacacatcaccctacctaaaaagccagtaaatgagaacctgtcagctatagccatcatttctgagatgcgattttctttgggattgagctgcagtgggcagtggctccttacactgtaattttaattctctgcctgcccagcctctctgtcaaagtagctggtgatctataaagatgctaaaaggcaccaggggactttgccatttaaaggactcctgcagtgaattcttttgtaaaatgaataatggcaccctaatttatccactttctaaatttgggtccatgggggtgtccagggcatgcttatgtgctgtcaccagcagacaaacagagggaatggaatctgggggttccttccctgctctcccgccatactcaggataccctaccataagtgatttcctctcactgacttgcagaaaatgtgtgagatacccagcaagctaagaaggcagttttgctgggtatctcatacccaaggctggggtttgggtgatctgagaggttagctccttgatcctaggatggaagggagagcttatatagaagcttttacttggaaggttttgtatcctaaggtcagacatagctatattaccaagcctaaatgccatgtggcccaggaaataatttggacatttgttctaaaccacttgtggtaggtattggtctctctgcaactcagccattaattagaaattagttttgagcctgaattttaaaaagccaagtgttgcccccagcccacacacacacacacggacatgtacagtacaaaccccagataattacaacagccaaagagagaaggaagtgaatttcccaaccagaagcgtagggaaattcagatggctttcttttctcccagcagaggaacagaaggcggagctaagggcaggaaccaggagttggtcaaggagctataggaggtgatgagagtagaaccaggggtaggagctggtctggtacccctcaccctctaattgggagcccagggagaaggactgaaaagaagatgggagtggaaaagaataaagccagtttctgcttcccagggatgcagagattggggcatgctgtgtctgcagaagctcctagtcatttccgccataattgtgagagagaggggcagccctcccacaagatttttcccttcccatatcacttccctgaatccccttcctttccccccagtacagttaaacctctctctaatttggaatgttatatttgagaagatggccactgtgaataagtgacaaacggaatgacagtgtctatttaatgaaatgcatgtcttcaaaatatatacagaactcgatgaacaaggctttttccactcctcagggagcatgcattaatgaatagataggattcaaaagtctgttttctggtatgggttaaatatcccctcctacagacatatttccaccactaatttgcttagtacaccttttcttcacagataaaggaaaatgcaagctcagtttttcttcagattatgaagaaattccaaatccacaggggtttggattaatgaggttttgctgtactgcctccccttattcctcaacatgaagttcccacctcggattggggatgggtgggagggggtttcaagaggaggagggtgggatgggcaaggaatatacacaggtgaagccagagaagggttaggttgggggtgcggtgggaacttgctgttttgatctggtttcctggtgtgacactctgggttaaaggcttgaaggcccctgttaggagtctaggggtgagattctcttctctctgatcccagaggacgttaacttctactgcaggtgagaaacaaaataggaggatggtggggactgtcctgggaggagggggtggtccatggcttgtggtgtgggctggctataggggaggccactgctaggggactggcatccaggcccccttgaagcgtctcaataagtccgcgctctcctttttggtgtcttgcaggagaggcagcttccccccttgggtccaacaaacccgcgtgtgacgctggccccaccgtggaatggcctggcccccccagccccaccacccccaccccggctgcagattacggagaacggcgagttccgaaacaccgcagaccactagcccacccagcatcagagaccttctcttcctttcctgtgcaccccaccctgtaacagcaccaaccaccaggattggacatcaccgaggaacagcgggattgcctccccgaatgcctccctgggaggcacactgattgcccacccccaccactgcaccatttccaggagggagagtggggaccctcagccgcccccttttccttcccattggggtgctgccctctctttgacccccagggacccttgccccaggacaccgcctaccccgtacagaccccttcactccggggtgctatccccatcctctgcctcatcgttcccctgagcactgggggacagaccctcacccccaccctgggggtgtggcacctccaaactttcaacttcagggtgatttttttagcagtaaccagagctgacaatctaactcccctccaccgccccattttggcctcccctgccccccttgttatggggaggggaccccgggtgagggggccctattaccccttgatttctcaggagcgtctgggggggctcagcacgcacaaactccttctccttctaccactcttaaatttactccctccccacccagaacccagatggggtggagggggccaccggggcagggagggggcggcaaggggggaatgggagttgtctccccttctccccacacctgatctgctctcggctggtcccagagcggggtgagggggcttatgcccccccctcccccagtgtgttgggtggggtggaattgaggttagggtgaggggtcagggtttaggagggtgtgtatgttgggaggacaggctagttgatctgtcctactctgacacacagtcccctctgccccttccttctctcttcttggtctctactcccagggggaggggggaacttactctaggaaaagccatgtctctctcccccagggtggggggacctgtgttggaggaggggtgttggggggcccccttccatgactctgtcccctgggggaggtaggacagggctgggcttccctctcatcctccccctcccaatctccttccacctccctccctcccgccagctccacgatttttcggtgtttctctgtacatagttttctggcgggataggggaggtaggatggatggggtttggggtgggtaggccatgggaggggagaagcccctccttggcaccccctcttccctgactgctgtcccctacccagccttgcccccttcatccttttgcgtttggtattgagactctcctagactctactcctctttcttttgtatggacagttccccttcagtcccatccccctacacatacacccagccggggccaaatttatacttatataaaagttgtaaatatgtgaaattttatccctgtgccctttccccacctcaggccctacccctggaccctccccaaccttccttctctcttctttggctgttgtaattatctggggtttgtactgtacatatccggggtgtgtgtgtgtgggctgggggcaacccttctgtacagagcttcctggccccctccccccccgcccctctgcttccctccccacccaccacctcaagggtagggagttgctcttcctacctgttttattttgttttctcgttctccctccccaccccactcccagccttatctatcccccctcactgtccccttttctccactcccagccccatttcctttttttctggagtgtgtggtgaaacagaaaaaaacatgtttaataaacggagattgttctttta

SEQ ID NO: 4 - RNA, 84480 nt, Homo sapiens
aaugugcaggaugacaagauggagcaaacagugcuuguaccaccaggaccugacagcuucaacuucuucaccagagaaucucuugcggcuauugaaagacgcauugcagaagaaaaggcaaagaaucccaaaccagacaaaaaagaugacgacgaaaauggcccaaagccaaauagugacuuggaagcuggaaagaaccuuccauuuauuuauggagacauuccuccagagauggugucagagccccuggaggaccuggaccccuacuauaucaauaagaaagugaguguuuuuuaucaggcauauuuugcugcuaauugccuacugcauuccuuggacuguuguagcaccaacacaugccaaauuagcacaaaaucuuaaguauccuucuguuuaagaaaugaaacacauuugugggugguuuaugcauauacaugagaaaugaauugauuauaucauaacauaugcaacugucccaaaugcaccaugacaaauaaaaagaggccaggugcgguggcucaagccuguaaucccagcacuuugaggggccgaggcaggcagaucacgagguuaagagauugagaccauccuggccaacauggugaaaccccuucucugcuaaaauacaaaaaauuugcugggcgugguggcacacgcauguagucccagucacucaggaggcugaggcaggggaaucccuuguugaacccuggaggccgagguugcagugagccgagaugacgccacuacacuccagccuggagacagagcaagacugugucaaaaaaaaaaaaaaaaaaaagaaagaagagagggugggagggaaggaaggaaggaaggaaggaaggaaagaaagaggcagcuaauuuaacaaauugacagauucucuccacagauucgauuuacuauacaauuuuuuuguacuuucuguacuuggaaauacuuggaaaucucaaaaucaugaguuauaaagacuauacaaaauauuaguacuaauuuuucaugcaaacaaauuugaugccacaaggguuugcaauuucaaugucauguuauaaacaacaaaucaauuaauuuccugaagaaauuuuguuaccuguaaaauaacauuuuuacauaaacuagaauuuuacaaguuauuuaauauuuugguauuaauguacuaauauuggcaagaauuaacaaaaaugucauaaccugaagaaccuauaaacaauauuugaaugcgugcuuuuuucauauccaugcuugaaaugaaucuuauguuaagcauccaaccguucauuaugacugucauuucaccaaaccaaaacaaaaagcauaaaauuuuuuuuaagauuauugcauugauuuuaaauuaaauguaugacguuaggugauucguaacauuuucuucuuuaucacuugacacaaugcauuugugaaucuuaguggaaagguagggcacaaagauuguaauuaaguaaauuuuuuuguuggaccuggaccuuaaaauacccccuaaacuuuuagggacucuguuucuggcccaguucugugugaaguuaguccuugccaaaugcaugcaaaaguuuggcauuuguaauaugugaauuugaggcaguuuuauaaaucacuuccgauugacagcuacaguuucggaggaaagagcgucacaaaagguugacuagccuuagguucagauuuuuuuuuaacuuuucaggauauagucaguuuaaguauaacauauuuucccuuuuuuuuuuuucuuuuugagacgcagucucgcucuguggcccagacuggagugcaguggugccaucucggcucacugcaagccccaccucucggguucacgccauucuccugccucagucuccccaguagcugggacuacaggcgccugccaccacgcccggcuaauuuucuguaauuuuaguagagacgggguuucaccauguuagccaggauggacucgaucuccugaccucgugauccaccggccucggccucccaaagugcuaggauuacaggcgugagccacugcgcccggccaguauuuuccuuuuuuuuuuuuuuuaaacauuauacaacuuuaauguuacaccaucuacaaaucuaaauuacauuuaaaauuaucaguugacagugguacuaggauuuacuuuaggaaucacuacauauuuccccuuuuuaaaaacugaucuauucauuuuacaguagaggaagggauggaucauuuuccauguauuucauuuuccucuaacuuugcuuuugaacaccauauugucaaaucuuaguugauaagagauuauuaaucucauaacugccauuuaaguuaugagaaaaguugcacuuuauuauuuaaucaacucuuuggaaauuaauguaucugaaaagccaaagcccaaacuaaacaaacuacaaggacuuuauuuguauaagaaaaguaaaaaugcagauaauccaauugccuaaacauuuuaauucguuuaaaaugacuucgguauugaagugaagacugauguguuccaggcagaaauucauucacaguauagaguaugcuacuguauuuauagccauuggauacuuuuaguuuauucagaggcugcucuugggauauguuagugggcuccauccucaacaggccuuuugcuacccccagacaccggguccucaccucuuugguagcaaucaccaucuaaaaauuauuaaagccacccagcaucuaucccuuaaucaaacagggaagaaauuuaguaucucugcuccuaugcuggguccuuauuuguaaaauaauaaaugaauguuuugagaaagaccaaacuaaugcauguugacaaagguagacauucuucaucuggaaaccagaacaaccaaucaaucuuuuuuuucuuuaauuaaagagcuuucagacugauaaaagugauugucucgaggggaugucccuaaacaaaaugguccauaauugguuuauaaugaauuauauauagcaaaggauauaaagacagauguaaaacaaaauugugcaaacauuuucaaaauacucaaaagaaacaucuuaaaacugagggugaaaggccaacucugaugaagugacagccagauucuugugucgaggaaacccuuauaaacuuuguuaggcucacgucuaaacuugcucuuaacaucuucuguucuuaucuucaaaugcacaugguaugaggaaagaaaagcauuuuggcauuuuggagcaaaucacagugugcaaguagaacaaccugauaagggaaauauuguuaucaggaaagaguuuuccccaagguaagguauacucauggcuuuuacauugaacugacagcaagcaaaucuucaaauguaagucauucaacagcaaugcacacgaagcuuuuugcagggcugaaauccuuaaaaacuaacauggugugcuuagaacacaugauugaguuauguguuugaaauuuccuucuucugcauuuuuaugucuuaagacuuuuauaaguugccuguacacuuuuuucugccuuuaauuuucuuuucuaauuggauuauuucaguauugaaaaauauccuuaaauggaauuaauuugcucugacuaaaguuggaaugcuuagcaaaaucugaaccuuuuaaaaauaaugaauauuucuuucaauauucgaugacuaauuuuacuuuagugacuggguuaucugagauuggcugggugaucuucauuaaaacaaugcgguacacauacacaguacucuugacacagcuaaauggucaaacaguggaaaugucaccagggaaaauguuuauuaggacgagauuuuccacuaaugcugauacuggggguguggauuagauuugccugagugaaauggaauaugcaguuagacuagugauuucccuaaaguuggacucuaguacaauaguuaaugugucauuugcaucaguauacaaagacucugguuucuuucucaacuauauggaauagacaaaacaagccaauuguaaaaauauuugcagaauccauuccuuauguuauauuuuauguuaaagugcaguaguguacaugcaaggaauuuaugugaauagaaaaaacacaaccaccacacugaagcucucuguaaucuuuuacaaaggcagugucagugagcuuauuaaaaugucacugcugagaguauauuuuccaauggcauaugcccacauauuuuuauccucuuugucccaguuuaagaugugcaaauuauguaauguucaaauauucuacuaaaauuguuaaagcaguuuaauccauguucaguaauauuguaguaguaacuaaagaaauaguagcaucuaugcaucaugaacauuccugaugcauagaagcauuagaagguuuuuagauccucagauguuuuaagccuucagaguuccagguuaaaaacucaggggaaaaaaaugcuaucauaauauggugacaguauuuuucauaucauguuagcucugacucaguggucuuuagaacaugauuccagauugguuucccuuuguuuguuuauuuacuuuagcuguguagcaaggcacauuuuagcuugugaacacaccuuuuuuucccucacgggacuuuuuuucacaguuuccuuucauagcuugggcugauuuuguaccauuuggcccuacauucaaauucuuuacccacucuuuauuacagaaaaugucuuccuucucauguucuuguuaaaauuacagacgaaucauuauuaccauggaagaaaauaucauuuuaacaaugugacaguuuacuggaaauagaaugagacauuuuagaucuguaguaaaaauggauguuuguuaauuauggagugcagaaaugcauucauuuuuaaaaaguccuauggaucauuuaaaaguaacuuauucucucuugcuaucaacuguccugaaaagaugcacacucccuuuuucuugggcuccaugagaagucauauaugaauuugugauuucaaauucauguuuggucuaucacugccaaaggaguuuuuaguuguuaaauuggguggagagaguuuguuuuguuuuuaauuggaauuauggaguuuuucuugcaaaaguaauuaacgggaaaucagaaaagaggaugauuauuaaaagcuuauaauuucacgaauugucauaugggcaguccccaguguguagcuguucuuugcuuaucaucagcuccuguaaaacuaaaagucacccagacucucccuuacauccaggacccuguaguugacuucccaaucuuucucuucccuaugcacuauuucuuccuugugcuucuuuuuccuuugucaccucccugucucugucucagaaacagucccaagauggugauguugaucaauaaaaugaugcuuggcauuuuuagaguaucugccauaucuauaggagauccuucaacugaaaguuuccaaaacccaacagaaacaacuuuuggggaaaaauaaaggaaaugugucuagugaaucugguuuuaauaucaaaauacccaguaccucaaacaaugucaugaggguacuccuuuuccauggucagcucugcugucacccaugcuggcuucauuugcaggcuggcucuuccacaagauggcagaaauagccaccaguggugcuaaacuaacauccuacagccuuguaacuacuaucuucugcuaaaacaagaaagaagaaagaaaaaaggcccagguuuccuucaaaagcucuagcaguuguccuagaauugagucuaauuaggucacauggccuccucugaaccacucacuuuggcuagugguaugugauggucuccuugguaugggauggucucugucauauacuaaccuguguugccaaggggugggucagcuccaccaagccacaugggaagacaguggggcagagauuuacuccaaaaggaagagaagaggaacuguuagaaaagguguccuaagcaggcaaaaaaaaaaaaaaaagcuauguacucuacaugcuauauauaauaucaguauaauuacuguucuuuuuuaauccacagauucuuucaagauagcucuugucuuuauuuaaaaauaauaaaacugaguuuaaauaacuugccuaagacuaguuuuaaaacuagaccagugaguuuccauggcccauugccauguuaguuuggauuugcagucauagcacuaaucacagcaguggaaaaaaaaaaaagagaagucagugauggaaucuaaauaagccuauagcuguccuuccuguuuccuacucaugccauuuugcaagaugugauucuggucucccaggccggcaguauuucccgaacccuuacuggucauuucaacacuuggccauuuccugccuuuguaaaaccuuauuuauuuauuauuauuauucauuuuuaucaacaucaccaucuugggacuguuucugagacagagacagggaggugacaaaggaaaaacuaaaaucuuagacacucagugaucuagauuagcuucuaaaauaauuagaaauuuuuuuucccacuaaauuccaguagggugauaagcaccuauuuucaaagaggaucaauucaggaaauuuaaauugugugccucuauaaggaaauggcauuuaaauugggaucugaagguuaaaaaggaggagggagaggagaaucuuccaaggaaagagaacagcauagaauaagacauauaaucaagcugaccuguaauagguaagaagagaauaaggugagguuggggagguagaccuggggcuagauaaaggggaucuuucaguacaucuuaaagaguuugaagguuaucuucaaagcaaaaugaauucccaacaaguauuuagguacagcaguaacaugguccacuuuacauuguuaaaaaucacucaacuucucuauggagaaauuuaggaguuuuauacuugaucuagcauuuugacaauggagauggagaauaauggauagagucagaauugguuuuggagguguuuaggugucagacagaaggaagcugauggccucauuuucuuagauaggaaguuugagaagaaagauacugaaccugaaaauuccaauacuaaaauuggccaugcuuuggagaaacagaaauguucuuauauguguauauuuaagaguuagaauacagagacgcauuuuaaauauuuuaauccuuauauuuuuauugacacuuuagaauucacuaagggcauugacauguuuuauuucacuuuauccucaaaauaauccuaagauugguauuaguauaaucuucuccauugagauggagaaauugaggggaauaguuugcucauaguucucacacagcaagcuuguaaucaagcugggcucaaaaguguucuuuccagucaaagaaaaauuaacugaccauauaauaguguagcagacccaugguauguacauucugaugauauagggcugaaaaauguuucagcuccagauuuuauucuuuuuccuuguuguuauaauuucuucucucugcuggagaagagguugagggcucugcagccuuggcugacaaaagccuaccuaggcacuuucuagggaggcaccuucugcagaguuaucuccuccacuggccccaacccuccacccagcuaaagcauaggaacaagcaauuuuacagacucuucucuagguacaaauucuucucuuuugugugagcauauggcaacaauguuuaaaaacugacugugaggcauggaguccacagacauguuuuguuaaacuaacaaaauuauuuauaauuuugaauuauuuucuggcauuuauaaaucagaaaaucuuucacacacucauaaaauuauacaucuaaggauuccucuugaaauaugaguucaggcaucacugacuuauaugccuaaaacuggcagguaccuauugucacuuagccucugugggcauuuuaguuuguaaucuguggcuuaaggaccacaucugucauuaagugaaggcuauauauuaaagcuugguggcccacggguaggcaagugacacagauuguuguuuagucugguuaucacugguuggaaggaaaaaauugaaugagacuaggagaugaaaaaauauuaaauauggcauacucucuucagagucagguagaaagccugcaagaaaacuuuucaucccccagugagccagaaaaggaagaaaagcuuggcuugaacucacaggcuaugacaaaugagaagggaaguaggugagaccauuuaaaguccuuggggaaaaaauauuauauaccauggaauugacccagcauaagaaauguccccagagauauguauuauacuaauggaaucuccugaccaucuaugcugcucuucacacccaaaacuuugaagcaucucuccucuugcaacauggcucuaauucucccccuucaugcuggaaccucuuuccaagccagcagcuuagagcuaugaaaaacuuaauagcacuucuggguaggagcuagagccagauaauuuuccuggucugacuuccaggcuauuucaaggacagaacucugccauuuucagaguaacacuuucuuacacauagugauaaaguuucucagugccauucauucagaauuguacuucauuaacaguuugauagaccugugggucuagaaauauauguguaucugugagaauauauguucacauuuccaaacaauugacuuccaaaugcauuucuggagcacagcucauguacaaguuggaaauugccuguuucaaacuuugaagcuaaaggauaaauuuaaccaaccaguaguauauucuacauuuuguguauuguucaucaucauagcucaccuuccuguguuauuucuuguuuuugccaguagauuuacuuuaagaguaggaaagugcaauaaauuuggagucaguccuguuauuuggcaauguuucaauaauguuuagaugaaacacaaaguuacagcuuauguuuaaacuauguacuuugaagaauauggccccuagauugaaauaaauguuaagguaauggcuauauuuaaaugagaaaaagaaacuggaaaaccauggcuuguuaaauucaauguccauccugggaaaaaauuguaaacaaaucacuuucuauaagcccagaaacaagaaaagauuacuagauaauaacaaauauagcuucauaaauagcaauuucuaccaaaucauuauaacauaauuauuuucuuaguaacuauucaguuagaucaaggggcaagauuucaauccacauguacaacauaaucauugauaauuuggccaaugguuugugauuuuuuacaaccauuagguaacaaacauauuaacagcccugcuaugacagaaucaucuggauuacuuauuuaaaguauaaaaacuagguaucaaaaucugaccagcuaaauuggaaucacauuaccucuaugagcuaaguacauuuauucuguuuucaagugagauaacugagucacagaaaguuaagaaaccuguuccggaucacacugcuggaaggcagcaaaguuagcuuuugaaucagaaaucuaauuucagaguuugcacccuuaacauaagauaaaacaaaucauacuuauauuuucauaauguugcuucccagauuauuaaacuguuaauuaccaggguuauuaccaauuuuucuauauaacuuccuucuugcuuuuucuuuaaaaccagaaaugauuuuuacauggcaaggauugcugaagaagguaugagcuugcugaacaauggaugguuuaaguuuaggucugugcugcccaauauagcagagauuaauuagccuuguguagcuauugaguauuugaaauauguaaguguaacuccauauuucaaagaucuaagacuuaguauaaaaauauacauaucucaaaaauuuuuuauaucaauuucauucccaaaugauaauaauucagauauguuggguuaaagaaaauacuguuaaaauuaauuucaccugcuuuguuuuucuuuuaauguggcucucaggaaauuuaaaaucauaacuguagcucagauuuguagcuuacauuauauuucuguuggaaagugcuggucaagguaaccuucaucaauucuucuauauucuauuaaaacaaauaguugagcaucuccuaguuuauaaaugucuuggugucauaaccuauguaucuuuguuuucucuuuagaauguagcacagggcauugcaaauauuguacuaaacaguuaauacauguauucugaauugccaucaauugaaauuaacaauuggaccuaaacuaggucccugcucauacauaauuaccaacuuauuguauauaugcccaauaaacuugguaccuguauaugaagacauaagugacaagcuagaacaacccuauuguaugaauguuacauuccugcaaauaagucuguaaagugauuuuucauauauaaaaucuaguuguuaccucaguuacaaugccaugcuucaacauuuguuuugaagcagaaaauuauccacguguuaaaaugauguuauuaauuucaaacaguucuauuucuuuguagaacugcaauuaaagcauuuguuuuggcacuaaaaugaacugaaggacaaauauuaagaauagucauagaugugccugaauuguacuaaaccacaaagucuugcugcuuguaaguggagccagucaugucaauguuccuaugagccuugggugguaaaaagggguuuguuuugggcuagauacuacuguauaaaccuuuucuccuccaccaccaacuuugaacuguuucuuuuuuauucaaaugacuuaaugcaauaaaaguuauccugauaaguuguauuaaugaaaucuuuguugaacuaauuagauuuaaaggaugcuaagauacuucacuauaauaagcuaaccaauacauucuuuuaaaaaguuuuuaaaaagucacccaauuuaauaguucauaaaucuugauuagcuuaaagcuacacaauauuuguuuauacaguuuaagguacagcaauaucuuagcuagucuuugaacucuucccucuuggagcccuuucuuauacguauagcggggaaggcaaauauuuauauauuugaaaacucuagagcuacuuaaguauuuguuguaagcaaacaguauuuccuucagacucuucccucccuucaauaucaucaaugccacuuuugggagaaagcuguaucugagaguccuuggaaacaaguauccuuuuauuaauucuuaacacuuauaaacugaaugaucggcuucuuggcuauguaagcaauuacaaggagguaagauacagacaguugaggaaauaaacaaacauaagaucaauuacauauaauaagacugacauucuaaauggaacuuacucugacaugaaagugcuaucauauuuaaaauuauacauauuggguugcuauacaagucuggguacuguugcuuuauuggaaggcuguuuaaaauccaucaauaccuuaaagcuacaucuaugaaguuuguacauaagcauguauguuucaaucugagaaaaauggaguucucacagaagaaauccuaugaaaaaaugguccuuuaauguuggccuuauuguuagcuuccuggguagcaaggaugucuugcacaacaguaugucuuaugaaaaauuaaagcaaaacaaauaccguuguucaguaaaaaccuuaccaauuccauuuauaaauucaacuugcaaguauuuuccauugcacauauaaaucuuguuaccaaauaaucuucuacacauucuuuaaauuuuuaaaaugaauaaagggaauacacuguaaaaucaguaaauguuuucaucuaaggcuugaacaauugauaauuaugcccauuuguuuuuaacuuuugugucaaaguauuaauuuucucuaugucaaaggacuuuuagauuuagaaucacauaccaacauugagagugcuuugguuucauuaaacucaucuuacuuaguuucagcccuuuauaccuccuuuuaucuuauuuuuuaaauugacacguaauaauuguacauauuuaugaagcauauagugguuuuaauacauaugauguauagugaucagaucagaauaauuagcauauccgucaucucaaacauuuaucauuuuuuguguugggaacauucaauaucuuccuuccagcuauuugaaacuauauaauaaauuauuuuuaacuguagucauccuacagugguguggagagcuagaauguguuccuccuaucuaguuguaauuuuguguccuuuaacagauuucucucuguccccaccuuuccccgauuuuugucuagaauccucugcucuuuuuacuucuaggcagacuuccuuuuuggaaccuuuuguguuugguuucugaaucuugccucuuuuacuuuuuaguacucagggcagaaauauuuccccucccuucuuuuagaucucuagcuuugccuuuuacuuuaccacuccuugucugucuuuucuguuuuggucauuuauuaccucuggucaugguuugggcugaacaguggccaaggagccagcaucacagguguucucuucuaaguaugguccugucuccuuaggaugagccugguuauuuuccuuauccacggagguacaaacaguaccaucuugauuauccucacacuccagcccaugauuuaggccaucuauggauugucauuucuuucucauuaucucuuuguaucacuacuauuuguuucaaaauuagcuuuuaauauuaucugaaaucaagagauucuuauuuuaaaauauauauauucuguguuauauuuuuacugguucuccuaccugugccccuaauauuucuuuuucuuuuuuucagauggaguuuugcucucaucacccaggcuggagugcaguggcgcgaucuuggcucacugcaaccuccgccuccuggguucaagcgauucuccuguucuccugccucagccucccaagcaacugggauuacagggacccaccaccaggcccagcuaauuuuuuuguguguuuuuaguagagaugggguuucaccauguuggccaggcuggucucaaacuucugaccucaggugaugugcccacuuuggccucccaaagugcugggauuacagacgugagccacugcgacuggccaucugagccccuaauauuucuuucagauuuuacucagcauaucuggggggaaaggaaguauaugcaguacauuugaaagguggaccauauuuauuccugagcuagcucacuuugggccuuucugugucguuacaugcucauauucccccacagcaaaggcauuugcauugcacaagucuguucagauuuacgaugaucucacaaugucauucagggacagaaucccucaaugaaucagagaaaaagagggcuaaguauuguuggcauaggggauuguucuucuaguaagcacaggugaaauucucccuuccuucaaaugcgcuuugugguaaagcucuaucuguuuucuggacucauacuccuucaaagaugauagagggaaugcaggcagaggugagacuuggagcagugcuucucaaacucuguugaggaugugaggucucuauucuucuauaaaaugaaguaaaaauuaguuucuagaaaacugaaaugaaaaacaggcccacaacaacaucccccuacuuuuuuauuauuagaauagacagacacaacauuaauuggccaaauugccuuacaaauuucuaaacauggacucuccauaucuauacuuaaccaguacugguugggggaccauacuuucacagccaguuuaggacacuucuacccauaccagauagaaagugcuuaauuuucaaaaaccaacuccauuagcagguaggggugugggaggguggguuugcuuuacuugaauuuagaaaauccugcaaguauaggggaaaucuguuaaugagcuaagacuauacaaagauucuuaguagaaaauaaacauaacauuuaugcuugcuguaucauaacaugaucugugcagauaugcauccuaaggcuuagaaaagaaagcuuucgaagaaugggugaauuuaaaaucaagaagcuuaaaauuuccuuccccaaauaugcucuucacagagauaaaggcuuucucccuggcucugucuaaauauaaguaagcaccuuggaaaacauugagucagagcccuuuuuauacccuuacauguugcuucuuuaauguuuugucugcccacugccaauugaucucaaauaagucuaauuuuuggaaggaauuucauucacauucauggauccuggauucuucaggagcuuggagcuucuccucugugauaagaaagcacugcauaagauaggaagucaauugggauuagaauucaauaugucagcuaacucagaaaucccaguacagaauuuagcacuccuggucaacggguacucuccagggaucuuggccuccagaaaucaauuauuggauuacauccaucuaacccaagaguggguuugaugguggcuguuuuuauuuucuauuacgaagagagugauaauguuuauuuuaugaggauagaugguaaaaacaaucuuuauuucaaaaauaguaucaguucuguugaaugauuuugcguuccacaggauuaauuuucaagauauuugaauugggaaagcugaaaugacuauaaaaagcauguagugccuuaaguuuuuuggaaugaaaugaaaugugcacccauuuaagacuuucauuuaacucagacacuuaaaauaucgagaaaauaaaugacuucucuuggcuaauugucuuauguacaauaaaauugaggguaaguauuagguaaaagguaagugguaucauuggauuuccucucuaauuaagaagagauccagugacaguuuguuuucauggggcacuuuagaaauugugauugugcugguuucucauuuaacuuuacaauaauuuauuaugacaaguaacagaaaguagauaacagaguuuaagugguuuauacuuucauacuucuauguuguguuccugucuuacagacuuuuauaguauugaauaaagggaaggccaucuuccgguucagugccaccucugcccuguacauuuuaacucccuucaauccucuuaggaaaauagcuauuaagauuuugguacauucauauccuuuuucaagugauuaauauuaacuauuuguacaugaucuguaagcacuuuauagcuaaauaucaaauuaaguugggaaauguccauauuauauaguuuucaucacucucauuuugcaucuuugucauauuagccucauucuuaaaguucauuaaucacauagacauuacugaaacauguacucuuuaacauuuuauauauuauauauaaacauguauuuauguacuuuuguuaucuuucuaaaaacacuuauauguauugaauccuacaaaucuaaaguaagauaaccauguuuaccucuaccaucuuuauacaaaguuugugaugguguagaauuuucagugagcaaugauaugauaacagaaaaaucuacuuccagacucaaguuuauccauaguuaugauauaaaacacuucaguguaucuuagaauaaaccuuuaaguauauuuucugucagagaaugucaggagucuuuggccaguacuuaguuaauucuugaaauuuccugaugauuuuugugaaggaaguacuggaauauuggcugaauuucaaauucaagucaugaguuaugaugcugccaugcaaaacuguuugcuuaguaaagacuccggaaguuaaugagagaaguuggcauauauuuccaaauggucuuaagggauuugguuucaugauucccauugguguuaaaaaggacuccacgacuaaauucauuuguuaaucaauuuaggaaaacaauucacuucugauuguaucuuguuugauagcuuugacaauaauagauauuaaaauaccauuauaauuaucauaagcucauacuuuuuuuuaaaggauucuaaaauuugaacggccauucuaauuuuaauaugacagcaagaaauuucuuuagugguauaaauaugcuauuacuaaaauuaaaagauuugaaacauaaaaaucauaugauaggguuuuuauacuuagggaaguuuccuugucccaguuuguauuccuagcgccaucauguggucauuugaugaaaacuuucuuuuucaauuauggaaaauuuuuguuuuggcaguaaacuauaguggaaagaauauuggaucuuaauguaggaaacuuauauucuaguccuggacccuuuaucugauuccucuagagcuuaguaaggccuuauuucccugauuuuuaaaauauagugauaaacuaauuuuuagggucccuuucaguuuuauaauucuguuaugucuguucauuuguuuuagcuaccacuuagaguauauuuacuuacguaccgugacuguuccaagcauuuccaauacauuaacucauuuaaucugcauguagaaaugguuacauuacaaaaugaguacauuauuagcuccauuguagagaaguaggaagagauacaaggcaauggcacagagagguugagucucuuggccaacaucacuuugcuauguugaauuuuaauuacauucccaucauguuaagugucaaccuucaagaauauucacuuuuaauguuaucgaauccugcugcacuuguauaaacucagucaaaauagagcaacccaacaauuagcaucgugcuguacuuugacuacaaauuguuuucaugcguugaacuguguuggauaagauguguuuaagaaauuacaauauugcagauaaguggccuuccucaacaauuuacuaguuuauucaccugaaugagcucaagucaauacuuucugcugaaaaacugugcaacuccagguagcacaaaaauagucuucccacugaaguucucugggaggugaauauauugauuuaauaauaguuguaaaaacaacaccuuauacugauauaaugcuuucauauacauuaccucauuuaaucuauacaaauacucagugaaggugauauuauuacccacauuuuacacaugaagaaauugaaauguaaggagauuagaagacuugcccacaaugcauuuaucccugaauuuuggcuaagcugcaguuugggcuuuucaauguuagcuuuuuguaauauaacacuuggauuuugauuuucuuuuguguguuccuuaacaauaaccuacauuauucagcaugcuaauuaugugcacuauuuugacaaacuguguguuuaugacaaugaguaacccuccugauuggacaaagaauguagaguaaguucaacuuauauuuuuaauaacauauauacauuugggauuuugaaacugugucuuaauguagucuuaaaauaaaacugaagagcauuuuauuaaagucauuccuagacaaaauuacgcagcaagaggacaaugcucauuggcccucaggccugcuggcguuauacugauuaucacucucuuuugccuguaccugguguucaccugaagaccaccacucuuggacauuuaccccuuuuucuuuaaaaucuacaguagccaaaccaaauguggucaaagcaauugcagaaaagagccaauaugguagacauugguuccaguuaaauuccagauaaauacauugaaucaagaaucaaaaaggguuaguuacaaaugccaugugaagacaacauugaaccucgcaaaguuuucauuuccaucaggcacauucacuucaugucaggccaauauaguuccaagcguggucaccaacaaauugaaaaauaauccaaaguuucaggguuguagaacuugaaaauucaguagacugaagacuaaacuaacagaaguggaacuuuuuguagagcuuucagaaaccagaagcauuacuaacuauauugaugaucucucuguucuggggauaccuucgaagcacagaggccagauuugugauaacugaaguugggcuacucuaaccauagcugcucaccugcccacacuuccuauuuguaaugccuguuacuauacagcugcugacccauagcaacuacagaaguauuagguugguguaaacauaauugugguuuuugccauuaccuucaauugaagcuaauguuugcaccaaccuauuuccaagaguguccaccaacauuugcaccaaccuauuuccaagagugucuccuuuccuagacacuuccaggcugaaaccaauaagaaacaugacaucuugaagaaaauaauaaauuuuauauacaaaaaaauucuaaaguauugaagcuaauaugggaggccccacagguuuucagucgcccuaguuuucuugugauuuuaugccacucucacaccccaauuucugaguagaagauuuaaacuuuggaaacaccuaaguuucugaauuaucagaagaauuuuauucuaaauuaaauuuuuacuucuuauaacccuagaaguauuuacuuugauuuuaaagaaguccuuguuccaagcaaguuaaauuaucuuguagaaaaaaaaaaacacgugcuaauuugucaguuuccucucauucuuagaacacuauuaaacuugagauuuuuuucccuaaaagaaaaucauuucaugcuucugcaauauuauugauuggcuauuccaucauguaaacauacuaaauauuucucaggagacuauauuuacauaaauaccaagacauuucagacaauggcuaaauagauuucauauaccuuguauuucucacacuacucuuaagacacuuuacgaaacaacucuuuguguuaggaagcugaauuuaaauuuagggcuacguuucauuuguaugaaauuaaaauccaucugcuuaguuuucuuuuuuaguauuuaucuauuccacugauggagugauaagaaauugguaugcuaugaaaaaacacuguuacuuuaucaaauuuuuuggaugcuuguuuucagauacaccuucacaggaauauauacuuuugaaucacuuauaaaaauuauugcaaggggauucuguuuagaagauuuuacuuuccuucgggauccauggaacuggcucgauuucacugucauuacauuugcguaagugccuuuuuugaaacuuuaagagagaacauaguuugguuuuccaucagugcuuaugcuuuuaagaauagguuugcuuuaccuguagaauauuuuggugugauuuauacauucaaacucuggauuucaauuuagcacaacaaaggucuaaguggaauuucacuauagcaugaaggcuuugcaguaguugaaaacuacaauuuucacacguagcaucagucagaaaauuucacauaugccacucuuccacacacacaugcacaaacacacacacauaugaacacacacaaucuaaugucaaaacacaagcauauuuguaauacaucugugaaaauaacuuuaaaaauuacagccacaaaacaguucuauuggcuacacaaauuugcaaugaccuugcugauauuacacacagcuucuuuuauugguuugguaaaauaauugaaaguaaguaucuacuagcaucaaaacgaucugacaaaucaaacuaagagaagaaagaagauacuugaaauauuauguuuuuaauauauuaaauuacugauuucuaagaccuguagaggaauacauucucucugccucuuucuguuucucuccugaccccuuuucuuucuucuuuucuucuuuccuuuuauggcucucuucaucucuuuagucugaacauaaacuuccuuauccuuaucuccuauucauauccacucaguaauaugcacaguuuaugcaccccaaugcuuuuuuuucuaguggcaaacuuccucaggaagagacccagaaaaauaauagaaaaccauuccagacuaagugaaaguagaguguagaaggaggcagcccaacaacacuuacccucauccuuccuucaggagcugauuuuuuggccucuaacaguugugauguaguggauaggagcaggagagguggcacugauacacucaggacuccgaaugucuggucuuaauuuccuaucugaucaggaugagccaauucuuugcuaggcucucuggucacagcucaaaagaaggccuacaggacuucuauuucuuaagaacaaaauggcaguaacaauaggcgcagcauuggacccucaucaaguauuguucuuaauuugcuuaacuuuuauuuaaaaguuacacuaggaaaaucuuaucucauauauaaaagcaguaaggcaaacugccuuuucaugccuaaauuucuguugggugauuucauauauuuuuuucuaacuaaaacccuaaaccauagccaagauuuacuuucuuuuuacaaguuacacaugauguugguugcauugcuuuccagagugacaacaagggugucuacuuuaugaaguuuacauuuagcuaauggccuuaaauuaugugaacaaagauuaaugauggaaucuaauuccugauuuaccacuuauaauauuuaucauuuaaaaucaccaagaaggucuuuauaaaagacccaugcaaguaauauaaauccugcuaaaaucuugaauaauucugauuuaauucuacagguuuguaacagaauuuguaaaccuaggcaauuuuucagcucuucgcacuuucagagucuugagagcuuugaaaacuauuucgguaauuccagguaagaagugauuagaguaaaggauaggcucuuuguaccuacagcuuuuucuuuguguccuguuuuuguguuugugugugaacucccuauuacagguacgucacagaguuuguggaccugggcaaugucucggcauugagaacauucagaguucuccgagcauugaagacgauuucagucauuccaggugagagcaagguuagauaaugagacggacccaucaugugauucagcauccuucucugcuugacauucaguuuuacagaaaaucaggaaucauaagacuagguguuucaaagaaaaugauucuuauuguuuagacauaagcuuuaucagccuuggaguuuaacaaugucuuaugugagauacuguaauuugaggucaaggugaccugcacuuacaaauaucauggguuuuuuuuuuuuucaccauguuaguuuuaucgagaauuugcucccuuuuaaauguaccaaucuguaauuucuuauucauuagagucauuaaugacuauguguauacaaugcaaaucuucuaaguuuuuugcuaacaaaagagaagggaauaagacaauaaagaauagugugagucugcauggaggauuuauuaucuuaaggcacaauuauacugcagaccauuuucgguuguacagcaaaaucuuuccuacuuauaaauaggaauuuuaaaauauuuauucagguauuuuguuauaaaacugaccucugacccuaaugaaaauaugagacaaguuucaguagcaaaaaggaaaaagacaaggcccuuuccuuaauauaggcuccaugaagaacaugaaccuuccauuacucuaucucgacauaaugggauaugaaucuucauuucauuguuuaaaucauuacauuucuggaguuuaucuucauaaguucuuccccuucaaugaaguguugcuucuccacuagcguugcaaacauucuuggauuuaugaaugaaaucuauguuuucaagaaaauugugugaagcuuuuauuauuucacacguguuaagucuucauaguaauagacuucuuucuuucaggccugaaaaccauugugggagcccugauccagucugugaagaagcucucagauguaaugauccugacuguguucugucugagcguauuugcucuaauugggcugcagcuguucaugggcaaccugaggaauaaauguauacaauggccucccaccaaugcuuccuuggaggaacauaguauagaaaagaauauaacugugaauuauaaugguacacuuauaaaugaaacugucuuugaguuugacuggaagucauauauucaagauucaaguaagaauuauuguuauguacauuuccuuaaaaaguagaauuggauuguuuguaacacaaaggauaaauacuugaggggcuggauaucccauuuuacaugaugugauuagcacacauugcaggccuguaucaaaacaucucauguaccccauauauagaaacaccuaccauguacccacaaaaauuaaaauuuaaaauuuaaaacuaaugaaauaaauaaaacacccucuaaaaaagaauuacuaucauguauauuuggucuuuucauugcuaaugugccuuccaucuaggaaugaaaaauauuuuuaaaugauuacauaacaagacgugaucuuuuagaaaauuaccuaaucaaacuauuuaacaauauuuaaaauuauauuuuauuugguauuucuacccccuggauuuuaaauaauagauuauuuauauuucuggaacuaaaagaagaauuuuguuaaucaccuuaucaauggcuuccacauacauuuaacaacuuuguucauaacuacucuaguuuugacuccuaaaugccacuuucuauuuuaucaucauuuggaaggcugaagaauucagcuagaaagaauuuuccuaggauccuugguugcuauacauucuuccuguggugauugauauaaugaaaggagauaaaauaugugaaugcccuuugcgaauucuacaauacuaugcaaauguaacucauuauacauuaauuacacaaugucuuuaauguaucagaaacuguauaguacacuggggaaaauaauggagguaaugcauggcuucagaguguuauaguuuaauagauuauuuuauuaccuuaaggaaauaaagugauaccuaaaaguaaaucuuauucuuauauuuaaaaaguaguauuacauuaaaaagaagaaaauuacaguuaauaaagcuucaggagacaguaauagaaaauguuaguugggugcaguggcucacaccuauaauccuagcacuuugggaggcugaggcuggaggaucacuugaggccaggaguuugagaccagugugggcaacauagugagaccccuucucuacaaaaaaaaaauauauacacacauauauauauauauauauauauauacuuuuuuuaaugaguugggugugguggcaucuucccaucucagccuccuuaguagcuggugauacgaaugccaguagguccacuucaaucaccagcucccugaaaucuguuguuuguuuguuuuaucuaaguucaaaauacugacuaugaggguuauuuaggguuuauucucucuagggaaaauuuauuggacugcauuuuuccaauacucgaaguaaaauaauaucugaggucauuuucagcucuaaacaucuaugguucuuauuuuaaaccaaaugcaaauauaaauaaaaugguucauuucugaaaauaauagaaaauuaaauuuauuaaaauuaaagguaacuauuauaacugaaaaauuauauuuuccucagguuaaggcugaucauuaagguuagaucauugaauuuaaugggcaaaacuucauuuauaaauaugagauaucaaaaauucauccagaaacuauuauaguccuuucucuuuguuuaauuuuaauugaaaguuaggaaauacuaugucaacuuuccugucuagguucaaggaagucagaauauuagaaauaaaaaugauauuuuuccuuaugugcuucuguguccuguacagaacuauguauggaauaaauuccucagaaaacuuagcaucuagaaaauauaucuucuuacaaaauccaacauugauuguuuaauuccauguuuuucucuuuuugucuuuuauuuacuuauucauucaauaaacuuuacagaaaggcuacccggucucaaacaaacacuaauauagaaauaauuaaugauugggacuuucuaggaggaauauuuguaaauaaauaauuacaauauaguagugucauccuaagaauaauucaaguauauacagguuacugguagcacagugaggggaguucuuaauuaugucaauauuuaguagaaagaaaguugaaaauaccaaggaaaaaguuauagaagaacuggacauugcaagaagccaaggaguuugcaagaaacaggaaucuuugagauaauguaguguucaccuauagucauuauuuuagcuuuaguauuuaagacuuuuuaaaauugcuuucauuucaguuguugauaugauuuaugcauauuuuacuauaaguugccuauauucugcaaaaugugagaauauguuauacuuaauuauuaaaauguauaguguuaaaaauauaggcgagaggaccagaaaauauacuauucuuuuauuuugaaauauguggcuguuuugcaaaaacaaagaaauuccugucauuccugucuauuuuuacugaaugaauuuuuuucgugagaauggugaacaaaugcuaauaccuuuuugaaagauuauguuaguaccugucauuaucacuaacuuuacauucauaaugaagaaauacuuugcacuguaaagugucuaaaguaucuuugcacuguaucuaaucuaaugucauuucuucauaaugaagaaauacuuugcacuguaaaguaucuaauagaauaucuagaauuuagagggagaagagacaaauacuugugccuuugaaugaauaauauauuuaaaauuacucaauaaacuuaaaaguagaaccugaccuuccuguucucauuugaguguuuuuaacaaugcaaauguucaucauacgacuuucuuuuuucaaacaggauaucauuauuuccuggaggguuuuuuagaugcacuacuauguggaaauagcucugaugcaggguaagucaauaauuuguguguaucuguguauauuuguauguacacauacauauguguaucuuuucucucuuuuuauagaaacugaagauaacagccaacuaauuuuauugacauuaauuugcuauauguaagguuuuugauaaaguaugagauuauguaaauauuagguaagauuuauguuuucuaaaacaagaaguaauacuuuuagacacaugcacacguauguucauugcagcacuauucacaauagcaaagacauggaaucaaccuaaauguccaucaaugauaggcuggauaaagaaaaugugguacauauacaucaugggauacuaugcagccauaaaaaauaacuagaucauguccuuugcagggauauggauagaacuggaggcuauuauccuuagcaaacuauugcaggaacagaaaacuaaguaccgcauguccucacuuauaagugggagcuaaaugaugagaacacauggacacauauagggaacaacacacacuagggccuaccagagugugcaaggugggaagagggagaggaucaggaaaaauaacuaguggguacuaggcuuaauaccucagugaugaaauaaucuacacaacaaacccucaugacacacauuuaccuauauaacaaaccuguacauguacguaccccugaacuucaaauaaaaguauaaaaaaagagaaaaauaucuauuaaacaccuacuguauauaacagcaaacauacaaaaagaggaguaauccuguuccuacuuuuuuaggaguauauaauaauaacaauguuguucuuuuagauaaguauauugagcuauaaacucuggagacuccauaguaguaaaaaugaaauggagguguugaaaaugcaaauuaucaacaaaaauuauuuuguaaaauauuauuagaaaugcugcaccauauuuuaaugaugacaccaaguagcuaauaagacuauaugcagucaaaaguugggaaauagauuaguuacuuauuugucaaacuuuuauuuugaaauaccaaaucuuucugacuaggcaauaucauagcauaguaucagaguaaaaaggcagcagaacgacuuguaauacuuucuuuuaccccacuugcagccaauguccagagggauauaugugugugaaagcugguagaaaucccaauuauggcuacacaagcuuugauaccuucaguugggcuuuuuuguccuuguuucgacuaaugacucaggacuucugggaaaaucuuuaucaacuggugagaacuaaagagccacacucuccauuuaaguaaaaguauacaagaaaaccaauugaguuaugaaauuaaaaccggaugauaauauaguagaaagagcagaacuugaaacgagacuugaguuccucuauccuauugauuauaacacauacugagcagagugaugccaaggauugcaauucucucccauuucuucuuggcucaaaaccuguucccuacccuucucagacacagauuguccuaaacagaaggcacauucucccuucagcccuaucuacccccucaaauauuaucccucaggugggaaguaaugaaaaugaaaaagcagauauagaaagauaacuuuggucuguuccuugacuuuccuaaaggcucaggucguuaauggaggacuccauggcauuuuauugacuguuucauucuuggugaauacaaaaauucugccauagaaaucauagugugaaugcauaagcuagaagagaaggaagaagcugaaguuaaagaaacaauaaaaaaaaaguacagggugcuaugaccaacauaauuacuauuuauaucugaguuuugcuagacacaugaguaaauugaaaguugaagccaccacuuagugaaauaauauugagaaauaauucugauauuuuuguuugcagacauuacgugcugcugggaaaacguacaugauauuuuuuguauuggucauuuucuugggcucauucuaccuaauaaauuugauccuggcugugguggccauggccuacgaggaacagaaucaggccaccuuggaagaagcagaacagaaagaggccgaauuucagcagaugauugaacagcuuaaaaagcaacaggaggcagcucagguaaagcugcccugucucauggcacugaccuuuuaucguucugauuguuacguaauauugaagagaaagugaguaccuaagagcaggugguuguaugaggaauuaauaaugauuucuauauuuugaugauccacuuacuuuuauuuaguuuaauuauuuuauuugagauguguauaauaauaaccacaauagaacucucucaugcuauuuuaaucaucuuaagauucucaaaguaaagggaaaauguuauuuugggguauuuucaagugagagacuuuuauucaaugaguagacuggcauuaggaggaaaucaucuuuucuuagaacaagaaauuauugguuaucauaugaagaguugcuccucuaguucuuaaacauagucuccuuuuuucuuuaacuaaaaauauguuggcuuuuaacgugguugcuuuauuaccuuuauaaggaagugaucaaauaauauaaugaucucugauacagcagcauccaauagacauaugaauguuaccaaucuuacacagauugaccaucuaaaaaggauuacuuguuuuuauagugaaguguuaguccucacagugugauaaaucauaaaaugccucuccuaucucucucaucuuucuguuuagcauacaaacuuauugucuuuacuaaagaagaaaguuguuucagaaauauuaauuuauaugcaagaguaauuaauuuaucgagguuacccugggaacaaugauaauaauaaaaaagugucaacuuaguaccaguacaagcuauaaucaaaaagcauuguuuuauuccaugcccaugugccccuuaagaaccaguacugauuugaagaugguggggacaguuuuuggagaacuggaugucuuaucuugcucagcagaaacuauugauucucccuuccccauucuucuggauauuguggaugggugagaaagggauuuuauaacuguccauaaauaggauuaauaauauuuugaggguauuggacaauccaauuucaauaacuagagaaaggaccucagguccuuaucccauuccccugccuuaaacucaucagcuuuucuuccauacucgaguuucuuuuucggagaaaagaaaacaacacuaauuaaauaccaauuuuuaaaguaaaucaaaucccaaaaaguaaugaauuuauuuucuuguugauacauguuggauauuuuugaauacguggucuguggagcauuaacagagacauaauaaauguuaccauggagcaaacuaaauuaucuccaaaagccuucauuagguagaaagaaaaaaaaaaucuccucuuauacuugcagagaaucuucucugugagaugaucuucagucaguucaauauauuuuuuaaaagccaugcaaauacuucagcccuuucaaagaaagauacagucucuucaggugcuauguuaaaaucauuucucuucaauauagcaggcagcaacggcaacugccucagaacauuccagagagcccagugcagcaggcaggcucucagacagcucaucugaagccucuaaguugaguuccaagagugcuaaggaaagaagaaaucggaggaagaaaagaaaacagaaagagcagucugguggggaagagaaagaugaggaugaauuccaaaaaucugaaucugaggacagcaucaggaggaaagguuuucgcuucuccauugaagggaaccgauugacauaugaaaagagguacuccuccccacaccagguauggcacugcugaguuuacugaugcaugguugaaaauuaaaacaugggagagagggggagaauuagaaaauggacucaggaauuuuuaucaacugaaucaaccacuguuguguuauauuuaaacccaucccuucuucacauaguuaugcaaaaacuuuacuccacagauauguaagucuacagcucgguguaguuaagauaacaccaaguugacagucaggagaacuggacugucauucugauacugucugcugauauuugucuauaacuaaugacauuuaaucuuuuugauccucagcacuuuuaagaaaaaaaaaaauguggaacuccggauagucgaucaggaauguccuuagguuauuuuaugauuuuauguuuuuuuucccccuaacuucuuuauaagucaccaugcaugcuucugaaaauauuagucaugguacacuugaucaaaaggcacaugacucugaauuucagaaguaugaacuucaaguuccaacaauacaaugccuuauaggugaaaaagaaauaauaauuaaagugauuuuagaaagguggacuaaaguaaauugugaggaguguugaaaguuuuugaaagacaagauccauaaaaaccaagguggccuuguuaaggucauggugccaguguucacugaauguuuaccacguccauugccauauucuaaggauguuucccuuugaacuugagaaauggucguucaggguguguguguauguguguguguguguguuucaauauguuaagguugcaaucuaucuccucauucuuuaaucccaagggcuagaaacuuucuuuuaucaagguaauuuaauuuaaugugaaugcacauaaaaugagaaugauaaucaaaaggaaugaaccauauucuguuaugaaugcugaaaucuccuucuacauaaucuugcaaaaugaaaucacauucaaauguccauauuaauaugacuuuauuuguuugcucuuucaaacuucuagucuuuguugagcauccguggcucccuauuuucaccaaggcgaaauagcagaacaagccuuuucagcuuuagagggcgagcaaaggaugugggaucugagaacgacuucgcagaugaugagcacagcaccuuugaggauaacgagagccguagagauuccuuguuugugccccgacgacacggagagagacgcaacagcaaccugagucagaccaguaggucaucccggaugcuggcaguguuuccagcgaaugggaagaugcacagcacuguggauugcaauggugugguuuccuugguugguggaccuucaguuccuacaucgccuguuggacagcuucugccagaggugauaauagauaagccagcuacugaugacaauguaaggaaguuuuaaauaguucaggcauggcuggcucacuauugcugcaccagccaguguuucuacagaacggcaaccuugagaaugauuccugguuggucacgcugugaaugcaccugcaucuuguaauaucuuuaauagacuaaccaacuaaaacuuaaaaccuuagcagucuccugcacaaaccugaaugcauuuacuuauuaaaagugcuaaggauugauuagacacaauaauuacugccuccaguuggaggauuugcuauauacccacacugaauuuagauagcaggacauucuccaaggcucugguaugaaaguaaaugaaugauucuauguuuaagugucaaggguauguaauaaaucuuuccaauggauucuucaagaucucugcuuuaguuuagauuuucaaaaacacugcuuaaguagauagcuucauuguuaccuuaauacuccuaguacucauauuuuucuuacuaaaaaaugcugauauaggucuucucaaaauuaaaugaagagacacaaauacauuauuaauacagacagauaaaauaauugucuguguacaaagguauguuauguguuuguggauguauacucagaugaggaauuucuaaacagaugcugccucuucuuagacuguuuacucacuuggaaauauaucagcaugaggaggcaugacuaagucagaauuagaugacuuauugcuuugguacccuggaugaaacuguuguccaugcagcauguguguguucuuuuuaacauagaguuuguguugucaaugaccaucuacaucuuguguccagaaaauaagauggcagcuaaguguguugcaaucauuuauacuuccuuaaaauuaaauagcuaccuucucaaaaaucaagugccuugaucacuuguaggacuuuuaaguuacuaggcuuuuacuauuaguucagaaauaaggguaauaacuguuaaauauaucucuuaagaguuuuaucaacuauauuaaaauuauuuuguauuuuauaaaauuaugaaaucaggaaguuaacaucuugguuuuugcuguaugacuaaaugguuaacaguuugaacauuccaggcuaaugauacaauaagucagaaauaucugccaucaccaauugaauaugaaagugcaugaugcauguguuucaugaaauucacugugucaccauuugguuguuugcuugucauauugcucaaauuaauuguuuaaugcauuagcauuuuuuuuuacagggaacaaccacugaaacugaaaugagaaagagaaggucaaguucuuuccacguuuccauggacuuucuagaagauccuucccaaaggcaacgagcaaugaguauagccagcauucuaacaaauacaguagaagguugguaacaaauucuauuuucguuucaauuauuuucaccaaacuuauauugucucauuucaaacaaauauauuugugaguugggaauagugcauucuaaugaaaagacagucuaauucaagagcuguuauuucuuauaucuacucagauauucuagaagccuuaacaauuuauuuuaaaaugagugauauugggacuaagaauguuuuccuaacuguguagcaacucuuugaaaaugcagaacaaagcauuucuguuagggguuucuaaucucauuagucauagugacccucuuuuuguuccauuaguuuaagacuucagcaguacagcccuuuucagccucauccuaaguacucucaagauuguagaggaagagcaggucauuuucacaaaauaaaaacaagcuaaaaagaugauucuugggucacaucaaucccuauucuagcucucauagucugagguugacaauguagagucauucacauaggguugcacacacaauaucuacaccacccuaaaccauguucccauugagacgucacaugaaagaccacucauuuaacuugaggccaagugcugagccacaaugucagugcauaagacaaaaaacuacccauuguuaccugggcucuaugugugugucugaugaaauauccuugggagguuuagaguaaacuguaauuuuuuuaacaaguacaaaaaagguugucucuguaacaaaaauguguugauuacugaaaauaaguuuaguggauaugaaauaaauguguguguauaaaguauaccuuuuggugguucuuuuuuuuuuuuuucuuaaucuagaacuugaagaauccaggcagaaaugcccacccuguugguauaaauuuuccaacauauucuuaaucugggacuguucuccauauugguuaaaagugaaacauguugucaaccugguugugauggacccauuuguugaccuggccaucaccaucuguauugucuuaaauacucuuuucauggccauggagcacuauccaaugacggaccauuucaauaaugugcuuacaguaggaaacuugguaagcauauuggaagguaaauguguuuagucuucaaauuuucugcuugaaaaacuguuuacauuuaauuguguauagcagucuuucaaccauccuucaugcuuccuggccccugcaaaaucgcaauuauauuuagcuggcuauacucuacuuuuuugccaaaaauaaucacccuuaaugugcucacaaaaacugagaaaggcauaggccuacagcacuacuugaaaagucaacagcaauauuuauaauuuuucaggauccagaaguagcucauagauuaagaacauacuuuuugagauauuauuacaauuucccuuacuguagaagauuaaaauaaaauuguggaucucuuuuauccuucuuagucaucaucacugcaagaaauaauuuaacaacucaaaaaugucuccagcuuuuccucuuccaggaucuaaguaguacauguauuguuuauccaucuauucuauaucaaaaccaugaacuauugaaaacuuccaguacauuuuguguguuauaugauuacaaaggucauuuuuggugaagauugccacuuaauuuuuccuuuuugugcuucaaaaacauaaauuauuaaaguguuugccagucaacucaacuuaggaauacuagcuuuuauuugcugaaggaaagagcuaucuaaaguaauuuaugcauuuccuguaauauuugguuugaaguuuaggauuuuugaugguagaaaacaaaagcaucaugcauaacaaccugcauuuuauuaguuauauuuuugaaguucuacuauuuauacuacagaaguaaauuuauuuuuuucaugugcauaacaaagaaugacaauaguaaugcaccuaguauaauagauaagaauguauaacucugauugagggaaauaggaauaagcuuauagauaaauaaaagugcucaugggcaaaauguugucaguacuugugguauauaaagucuggacaaaaagguaguuugguauaauggaaagagcacuguuaaaaauagaugacuugggcugggcgcaguggcucacgccuguaaucccagcacuuugggaggccgaggcggacggaucacgaggucaggagaucgagaccauccugccuaacauggugaaaccccgucucuacuaaaaauacaaaaaauuaggcgggcgugguggcgggcgccuguagucccagcuacucgggaggcugaggcaggagaauggcgugaacccaggagcuugcagugagccaagauggcaccacuacacuccagccugggcgacagacugacacuccgucucaaaaaaaaaaaaaaaaaaaaaaaaaaaaaaaagaugacuuguacucaaauccuaguuuugccauuuucuugcuguaugauaucaagcaagccauuucacccaucugaagaccucaguuuccuuaucuguaaaguaauaauuguauauuaucuacuucgcguuuccacaaggauaaaauuaaauaauguauaugaaagucuuucaucaacuacaaauugccauacaaauuuaaguuaguaauagaaucauugugggaaaauagcauaagcauuauguucuaagagcaaaucuuaugucauguauguuauuaucugguggaauuagauuaauuuuguuuugaucuuagguuuucacugggaucuuuacagcagaaauguuucugaaaauuauugccauggauccuuacuauuauuuccaagaaggcuggaauaucuuugacgguuuuauugugacgcuuagccugguagaacuuggacucgccaauguggaaggauuaucuguucuccguucauuucgauugguaaaaaaaaaaaaaaaaagcaccaaauucaaaaaccuuucuaacaaucaggguucuugcauagcaaugucauaguuuuuuugccacacaaccauuagcauuguaaguuuuucuguaacauuugcauugucaaaaacuuuuccuacauggaaaaaaauucucaauuauuuaugaaaaccuuuauuucaaagaacauaguuacguaaaaguuaacguauuacucaguugcuauuuucacuaaguauugcuucuagagacuacuacaguuaauauuucuagaccuaagaaaauauuuuuaaugaaaaugcaucaccuuuuaauaguaacuugaaaauauauauagcccuuuguagcaguggaugaaaaucagauguaagaugugcaugcagaaacuuuuucuaauucugucucuggaaaauaugcaucuugcgaaagucaaaggagagaaagucuguaggauuacuaagcaugcccauuaauucacacauauauccuuacaagucaggaaaauaauuguagaauuauaggaaauauuccaaguuuuucaaugcagguggauguaacuacaugaauaccccuaaggagcauuaaugaauaaugaacacuuuacuuauaucagggcucaguaugauguuacuuugcacacuacuggcaaauuaauaucuuucagcagagauauuucagauucagauguuaauauuauaauauccggccuuagaaccaccuuuauaaaacaaauuaagaacaguuggauuccaaguacucauuaaaaauucacuauaagaggccuggcuugguggcucaugccuguaauccuagcacuuugggagacugaggcaguuggaucacuugaggucaggaguucgugaccagccuggccaacauggugaaacuccgucucuacuauauauauauuuaaccaggugugguggcacgugccuguagucccagcuacuugggaggcuggggcaggaggaucacuuuaaccugggaggcagagguugcagugagccgagaucacuccucugcacucccgccugggugacaaaagaaaaaaaaaaagaaaaggaaagaaaaauaauucaccaucagagaaaaugaucuacaugguuaaaauauggaaaauccagcuuuuccuagggaguccaaaaauuagccaugagccugagacgguuagggcagaucagauauuguaagauauugaauucuaaugaccauuucuagguaaagcucaauauauauaaugcuuuuaagaaucauacaaauauauauuaaucuuucauuuuccagcugcgaguuuucaaguuggcaaaaucuuggccaacguuaaauaugcuaauaaagaucaucggcaauuccgugggggcucugggaaauuuaacccucgucuuggccaucaucgucuucauuuuugccguggucggcaugcagcucuuugguaaaagcuacaaagauugugucugcaagaucgccagugauugucaacucccacgcuggcacaugaaugacuucuuccacuccuuccugauuguguuccgcgugcuguguggggaguggauagagaccaugugggacuguauggagguugcuggucaagccaugugccuuacugucuucaugauggucauggugauuggaaaccuagugguauguacccacuuaagauaugcauuuuggaaauacaccagcauggcacauguauacauauguaacuaaccugcacauugugcacauguacccuaaaacuuaaaguauaauaaaaaaaaagaguauaauuuaauggugacuguuuugucaaaaagaaaaacaaacuaugauuauugguuuaaaaguccauuaccuuggauauauuaucacuuuaacaacacagcaauauagcagugccccugcauuuuuuauaccaaauucuauuuugucagucacuuuaucacauuuuuuaugugaauuacaauagaguaucauauugagaugagccuaaaaggaugugcugggaccauuuuauaaauucagagccaaggaagagagaagucuaaaaaaaguagagagaaagugcaaaauuaccauccagacuaggacuaaaaaguggugucuuuaagaguucauaaugcuugugccauuucuuugccccauugcagcauaugauauucaaucacucuaugucauauggcagaugcacuagccaaccugaguucaucaguucucgaauggcuaaugaugccugagauuaccauaauggaguaacugaucaaucuuuaucucucuuaaauuuggaguguuacuguuuauaguauaguaauacauaaaauauucuaaagguauguacauucaugugccagucucauggaaauaugagagauuauucauaaacagcucuacuuagucaacaaugaaguaugagaaauauaauagauuaagaaaacaagugucagccuauguuaagcuccuaaucuucauucugaguuguaaugguuauuuuucaauugacauccaauuuaauaucuuuguuuauugaaaaauuauagaaugcauuuaaaugcauacuuggaaacauuagugauuuuuaagaauucucguauuguacacauauaaaucuguuuucuucuacucauacaauuuuagaguuaacaaaaccuuagauuagcucauucaauuucacuuuacgaaugggagaacuugagagcaacagaaaucaugucuuuguccaaggaugugcuauugagccagucacaaauucagaucacccaucuucuaaucacuaugcugugguguuuccuucucaucaaguuuuagaacuuagaguuuuuuccacacuuaaaagaaagaauaagugauuguaaucugcucuucccuacauugguguaaaauuauaaucauguuuuuguuguuuuuaagguccugaaucucuuucuggccuugcuucugagcucauuuagugcagacaaccuugcagccacugaugaugauaaugaaaugaauaaucuccaaauugcuguggauaggaugcacaaaggaguagcuuaugugaaaagaaaaauauaugaauuuauucaacaguccuucauuaggaaacaaaagauuuuagaugaaauuaaaccacuugaugaucuaaacaacaagaaagacaguuguauguccaaucauacagcagaaauugggaaagaucuugacuaucuuaaagauguaaauggaacuacaagugguauaggaacuggcagcaguguugaaaaauacauuauugaugaaagugauuacaugucauucauaaacaaccccagucuuacugugacuguaccaauugcuguaggagaaucugacuuugaaaauuuaaacacggaagacuuuaguagugaaucggaucuggaagaaagcaaagagguaagauucuauaggugugggaagguaugaauacauauacauauauacauauacacacauacagaugauccucagcuuaaugauguuuugacuuaagauuuuuuuuuuuuuuuacuuuaugauaauacaaaagcaauagccauucacuagaaaccaugcucuaaauuuugaauuuugaucuuuucccaggcuagcaauuugugguacaauauacucucaugcugggcaggggcagcaagcugcagcucccagucaaccacgugauuacaaggauaaacaaccaauauuuaccguacaguguacuguauucaggaaauuaccugaguuauccaacaguuuauuauaaaucaugcuuuccuuuagaugauuuugcccaacuguaggcuaaucuacauuuccugagcauguuuaaaguagacuaggguaagcuauaaaguuugguaguuagguguauuaaguaaguuuugauguacaauauuuucaacucacaaugaguuuaucaggaacuaaccucauuguaaauugaggaacauuuacaauacaugcauuauauugccuguauuuauuauuauauauuuuccauauagauuuuuuugacaucauguaaaauuuuauuucacugaggaacaaaagauuuaacucggaaaugacugauaaauuaaaggguaauauaguauacgugugaguuuucucauccuuaguaauggauauuuguuagaugaaugaaugaacgaucuaacaaauagacaaacaucaucagauuuaauccuuacaauaaccuggaaagaaauguguuauuauguuaacuuuucagauaagaaaauuagcuuagggagcauuaggucacauagcuagugaggggagugccgagaguugaacuuagagcccuuguuuacaaguucuguuuauuguuuuuugcaucacauuggcucauguacauugaagagaacuuaacaacaagaaauauucuuguagcuccuucaacuaaaauuacacugcccuaugcauuagccuguuuggacugccauaacacuauaccauaacuggguggcuuaaacaaccaaaauuuauuuucucauaguccagaaacuggaaaguccaagaucaagauaccagcagcaucaaugucuagugagggcucacuccuuggguugcagacagccaccuccuugcugcguccucacauggccuguccucaaugcauguacauggaaagagagagaacucuggugucuauucuucuucuuauaagugcaccagcccuaucagaauaaaguccaaccuguaugaccucauuuaaccuuuaucaccaccuuacaggcccuauccccaaauacagucauauugaagguuagagcuucagcauaugaauuuuguggagacaaaacuuuaauccauagcaaccuacuuugaaauauuaaguuaaaagucuaauggauauauaagauaauuaacaaggagucuaggacaaagcaccuuuacuucccauuuaguguuuggaaaucucaaaaacagcagggugcccaucuuuuaggcuguauagucuaaauauuuuaaaggauugaauacauuaaagacauuuuauuagagauacaauucuauuagauaucaucauguccauugcauuuugauaguuguccauggaagauaccacagguaugugacauucuuuugauuuagugacuauaucccuuaaaagaugcuucaaguauuuauaaugagucucugaauaaucuaggucagccuccacuuuuaggaguagggggcuaauauuggagcuggaagcagcugcccugacccuagcauuagagcugcuuaguuaauucagauuuguuugaugagagaagggaaagaaauauagugcagagauguaauaguagauagauccugucacauuuccaugucuauggaaauagauucaggacaaaaaaaaaauagacuguuuuuaucaaauauuguggacuuuuuuacagaaauuuuaauuuggauauuaugucaguucagacuuuguuuauuugaguuuuccuaaggaaucagaugaaggcuaauuuuuugaaaaauuguugucuuuauaaaauuguuucugaacuucuguuaaaauaaauuuaguaauagccuagucuagcuuccuuugucuugaaucuuuagaccuacauuuagcauuugaugaggacuaauggcuaccauaugcuaucuguuauauuaaaaaggaaaaagacuauuuuacaaagaccauccauaagauauacauuuucuguaaaaauuugacaugauucuuacucuuauuguuuuuuuauauugaucaaggcuaaaagaaacacuaaccuuuuuauaaagcaacuauccacugaagcacuagagguaguucuguuucuuucuacuuugugguauuuuauaucuuggaacauugcauuaauugaaauuuuaaauguuaagguaauagaaacuuuagagauaauuuaauguggugcuucucaaauugugagucauaguuuaguuagacuugagaaaucccuuuaauaggccaguuuuuuuuuuuaauuuuaaugaaauagugauccgcccaccucagccucccaaagugcugggauuacaggugugagcuacugcacccggccaaugaaauagaacagaauaacguuagagcacauuucaugucagagggagaaguccugguaaaugaagcuuuugccaccugugcugaacuuuaauguuuuguuugucuaauuagaaugcaaccacuugguucaugggcauagugucugaaguccaggaguucuuaagcuucagaaagacuguuucagcuuuuugaagguagugauaaugaagccuuccuaacccuaggcagaacagauugcuuucuuuuuugguucccagagauauaaggcauagaguauaguaauaaauaaugcaucuucuugacucaugcgucuuacaaaguacuaucauauuuuaggguagcuacuuauaugcaugcaugucucuccuuuuauguggugaccuacuuaaacauguuugguacaaaguagacacucagaucaaacuuuuccagcucauucaacucuucuuaauaaaaccauucugaagggcucucauaaauacuuucucugauuagagcauacuugagauugucauuuuaauuccaauuauuuuggaccaauuuuuucucuagauucaagauucacuugaguuagauuuuguuguuuuuguuuuuguuagccauguuaccuugucacuuuacaccacccuucuaagaaaguaauaaucucucaucuuuuccacaugaauugcuguugaaaugcaguuguaucucauccagacgaaauuuuguaauuaaauacugaaacuucuauuuauccccuaaugauacauuucaauuucuuuuauucauuuuugaaucuggcuuucuuuuuauauucuuucacagauuaccacauuguaucaaauuuccuggcacuuuuacuucacaauuccuuucuucuuggucagaaauaaacccacacaauauuguuugcccucauugcuucaucagucuuauacuguauucuguucaucaaaguaaggcauaaauuaugagauauucugcuuuuagaggaauuaagcugacagcagaugccccaauagaugaagagucuuuguucuacauuaggaaugcugccuguaguauauuaaucucaucauuuugguucuuuuuguuuuagccuuuauucuuuuugccuauuuucauuuauuuaucaguuaucauaugccagggagacuagauaaaggaguauacuaauaagcuauaaggaaugauuuucucucucugucucuguguguguguguguguguguguguguguguguaugacuuucaaccuuuaaguaugaauuuucauauugagacauauguuacugaugcaaaaauguuaccuuucauggccucuauuagacuaguuucauuugaacauguuauuguuuccauuccugaauuccaguaaugacuuaucuacaaugcaucauuauaauaccuccaaaauuauauuaaugccuuguguuaaaauuacaagugcccacuguuuauucuucauacacuaaauauuuguuuuuagacaugugaggccacaguuauaaaguugguaaaugguuauacucuggagccagauacuggguuauauaauuucauuuuagccgcuuacugugugacuuuaccuaucuaauaaucaguuuccucaucucaaaaaugugcauaauguuacugacugcauuucugggacagaguauuaaaugagauaauaaaugugaaguacuuagcacagugccuaauuaauauagaauaucugguaaaucaucauuauuauuguuaccaguugcauuccacacuguuccaguaaguuuucuuacaagaauuacuacugguaacauacuccacuauuugucuuuuuuuguuguuugccuuuugcccucuguaauaaauuguuuuauaaguuuaucuggggauggugauacauuuuauauuuucuguuuauuuuuaaauuguuuugauuacauucuugauaugguaagcuccuuaaaauauuuaagaaaauuacuuuucuaaggggcauuccaaucaggaaauacaaacaugcagaaaccuaaagacaggaagcaagaggauguauuuggagacaauuaguaguuuggaauuccgggggcguaaaucacaggagcugaggaugagauguagguaaagagucuugguuuccaggaagcaagaauagacugguaugaagagauguggugaacuggaaccucauauuuauuuugccucuuacaucuguggugaacucacaccuaacuauccuccauuccagagcaaacuaagggcuguuuuuucuacaccuuccuccuauuggucuccaaaagaagaaagggaauagcaugagucacauuucauccucucuuuaaguccuaagagacuucaaccuucaaaguacauucaaguaauuugaggaauuguuuuuuaaaaccucagaaaauuucuugacucaugccauaguaggaauaaugauaagcuagaaacaugaauuuuuauugaacauuaauaauaaagaauggugacuuggacagaucugagagagcuuugaaggcugggcaaaacugccaagacuaugcaaaagacaauauaaaaucuuaucuccccaaauagaaaguaaauuuauuuugguuuuggauaguauuuuauaacauuucuauccuccgaagcaccuaccacaaugcugggugcauaacaguugcccaauaauuuuuugagguuugguugauuuauauggauacuagauuaagagcuuauaagccuuaacucuacuaugagcaaaucgcuaaaucuauauuaccccguuuccuaauuuauuaaaugagauaucuguccuaugaugcuuauagaaauguuaugaagaucuaaaagcuauuuggaaguuaaaaauguucaaaaguguaaggugaugucaagaaaauuacuacuuaauuccauuuaaauaaaaauuuuaaauaaauugaguuauuaaaguuguaccuuuugggaacaaaaaaggcacauuacuaaaguaauuauaaaagaaauacauuuguuuuugcgaugagugagcucuagaauaaugaguaaaaaugugagguccuuaguaauucagguuauguuaauaacagcuauuguuuaaauguucaccauggacaaaguacuauuggagggcauauauugucccauucagucuuuaugccguaagacacacuguuauuccagccuuaagaugagaaaaauaaacauauuuugaacaaaggaaaacuugccaaaguuacacaaacaguaagugguugguccuggcagucugcuccauagucugcuccagagucacgcucuuaaccgcuacacuaaaucuuaauagugucugaaaauguacuuucuuuggcauaguucugaaauaaauaauacuauuuguugaagaacuagguacaggugucaacuauagauuugguguuaacuuccaaucacugcacauugggcauagguuaacagcauagucuggaguguuucagaguccuccugcuuaguccugaaagguccuguuccucugguacuggccugcacuuuaggcugaucugcuucugcaucccacacugaccugugguggucuaauucuacuuagagagcacuuagucucccagagugugauaguugugcuuaaggagcauccccuucugaguuuaaagcugcuggaagagucuuccaaaucauuaggaagaacuucuaugauguaucauuagcuuaugaggucuuugagaacaggaaaaacacuaacccugucuucccuuaaguccacagcacauacaacauauuuauuaaaugaaugaauaaauaggugaugggcaguuacuucuagauuuccauuuuuucccaauuauaucacugauauauaugcauuuuaaaucuacuuguugcuuugcugauauuuuuccaucuaauacuuuuaucuuacguuauauggguuaaggaacauacgacaaucuccaaccuaagcacauagucucuaagagauggcaacuacucucugcgaagaguacuauccauggaacccaagaguacuaucuccacuacuucuaauugaucacuagggacugccaaagcuaccuaucuuuguccaccucucugcauucccaaggccuuuacccagugucagaccuccaucaucuuccaguuuuacugcuacagccuccaaacgggucuccucucgcuaguguagucuugacaaaacaauagguggucuuucuaaaaugcaaaucccguaaccguucuguccucccuaaccuuucaggaguugcccauugcucacaguauggagucuauacuacuuaacauggguacaagucccugcaaaacugaccaccgcugacuccuucaguaucauggaauaguacaccucacaccuccccacccagcuauacuaaucuuucauucaauguaauucccuaugcuuuaucaguucucaucguuauaccuuuucucucugacaggaauacucucuuacucuauccugcuucaccugacucauccucacccaccacauccuucuugucccaaaugucacuuuauucuacccuguccuuccuagauugagcuaggugguguucucaauauacucuauacuacuccuauuagaguguguggcaauugcuucucuguauccuccaucugauugugaaccgacgagggcagauacuaagucuauuauguucacuauuuuauuuuucaaguccuaguuuugaugccuggcacauuuuugguagugaaaaaguucaaauaucaauaauuacaccuauuacaaacaauacaauacugugauggaaauuguuaccauuuaucaaauaagcauacgccaaacguuauucauguguuaucuuguucaguccuuauaacaaggaugugaaguaagaaccauuuuacaaauuagaaaccuaaagccuaaggaggucagaauaauugguuaaaguccauaaaaccagugauugugauucaaacucaaguuucucugauccucugaacaguaguacuuucaacucuuucauuauauagauauacaguuuauuugcccaguagacacuuauuaaguauguuauaauuuaacauuaaaaaucaaugucaaaauaacauuauagaagcucugugcucaauuuggcaaaaugaauuuaacaaugaaaauuacucauuugauuugcauuuugguuucuagcuuggggauuauaaaugcaauuuuucagaauuuuuuuguuuucuuuccaauuuuuuuguauuaccaugauuuucuauugacucaauaugucugaaauauguugcuuuuguucccuuauauuuaauuauugauacagaaguuuaugugugaccuaucgaaagcaaaauucagaguaguauauuagagccguauuccuccacguucacuuuuauacugggcaaguguuugacuaaagaauagaaacaacugacauucuguaaauaugaauaaucacugaagauuguccuuucaacauacagcuugaugaagaaaucaacugggaauaaugugggaauuaaugaguuaauauuugaguuuucuagcugcccuguggaaauguugagucucauuacagugucuuuuccauugauauuauauuuuccuuuguugagagucuuuaauaggggucauuuuaauuuuuaauaugcauaguguacaauagaaauauuuacuagugcacaauguacacaaugaaauauuaauacuagcauuucugagguuguagagaaccucauuuuagcaugacuuaggagauauaugugucacaauaguaaaguacccagcauuaaaauaguaccuguccagcuuuaaaaauaaguacuuuggauaauauucuuuauauguuaaauauauacauguguauguuaaauauauauauuaaauauauauguacacacauauauacauauacaaauauauagacaucgcaugaccacauauuaaguaugcuuuugacccuuaaauuccagauuuauuuauauuacuuauuauaauuugaacuccuacuaaacucuauaaauaagcuccuuauaacaaaccaaguuuaaaaauaaaaauauaaacauuguaggaucaagucagagaacaagaaaaaaagcauuuaaucacuuacucucagagaauauugaagaaaguuuucuuugccuugcuuuguuuugccuuacccucaaggucaaaaucauuugcuauaguaaagagcauuguuaaaaaacaagaaauuugcauaaauccacugcggaggaaaacugcucuuaccaucaggguuguaguuauuaagugguuauugaaugcccugguguacaaggcaaaguggaugcuucauauacaacguggucucugcauucugucagcucacauauuaagucagccugccaaaaauacauggaugauacaagucaguguauaaguguauaauuuagcuauuaagauucaugugugaaaauauacauauucuuaaauaaacuagccuauuuagaaauugguaaaauuuaagguugauucaugguuuaauaaacauuaaaauagauuuuaagaaauauuccgggaggccgaggcgggcgaaucacgaggucaggagaucgagaccacccuggcuaacacggugaaaccccaucucuacuaaaaauacaaaaaauuagccgggugcaguggugggcaccuguagucccagcuacuugggaggcugagacaggagaaugacaugaaccugggaggcggagcuugcagugagccgagaucacgccacugcacuccagccugagcgacagagcaagacucagucucaaaaaaaaaaaaaaaaaaaaaagaaagaaagaaagagaaauauuccauuaaucucuaaaacagugagaacaaauuacuuuauuagugaauagcaaauuucaaaaugaaauuaaauuucaaucuaagaacaaaaaaggaaaaauuaauuggccuuacugauuuuuaaaucuguaaaaauacuuauuugagaauauuuuaguuuugccguuauugaauuucuuuagaauuuuauaugaauucguauuucaugugcuaacauagagguggacuuuuccuacacaucugaagaggagcuuuuccuucccuuuuugaguauuuaauaauaauaguguuauuaucccaaucaaauaaagaauuggaccacuucaucuuuuaucucaaccguuauaagaauauauugaugcaaauauacugguuaugaagguuuuaauacaacuuuuuuagccuaugguaaaauauuuuaaaaaauagaugacaacauuuagauuuuggauaauauuaauagcaaaaguaaauaugacuguauauuaucucaaaaaacauauuuacagaaaauuuuuauuuucaaggguucauggaauauuucuauaaaaguaaccauauacuggaguucaaaguaaagcucaauaaauuuaaaauagcuggcauauaggguuauccagucacaauguaguuaagccugaaauuaauaauaaauugauagaaagaauuccaaccauuugaaaauuaagaaauugccuccuaaacaaauauugaauaaaagcauaauaaaauaccaaaauagcuauuucaaaaauaaaagcauuuuaugucaaaauuuguggaagaagaccaaguagucauuaauaugacuuaauauuacuaauaugauuaagaagggaugaaagaaccuaacaaauaucuuugagaaauuagaaaaggaacaaaaaaggaagaagauauacauaaagagaaaaaauagugaauuaucaauguagcagacaauauugguauaacagguuaugguucuuaggaaaaaaaaaucaguaagacacacaaacuuugguguaucaggcagaauucuaagaugaucucaaugacacuugcccuuguauaauccccacuccaugagugugguuggaaccuguggauaugguaucacccuuuaauuacauuacauuuaugacaaaaagggggaugaugcugggugggccugaccuaaucaggcaaacucuuuaaaugcacagugauuucuccugcuaucacauagaggaagcugaaaagauaugcucugccuggccuagaaaaaagcaaacacccauauuguaaauugcauacagcagccauguggccagagacuauggguggccucuaguugcugagagugguucugggccaugagcuggcaggaaaguaggaagcccagucuuauaauuaugagaaaugaacucugccaacgacaguaaacuuggaagaagauccugagcccuggaaaagaacuggauuuccagccaacaccuugacaucaucucaaugagacccugagcagagaauccaacuaggcagugccagacuuccgaccuacagaaacugugaguuggugaauguauguuaagaugcuggguguaugcucauuuguuacacagacacagaaaacaaauacauuuggcaaauaauccuuguuaggaaaacucaaaugauuuucuauguguaaagagcaauugcaaucaaauaagaacacuaauacuccaauagaaaaauaggcaaaagaccaagcaccguggcucacuccuguagucacagcacuuugggaggccaaggugggugaauugcuugagcuccggaguucaagaccagccugaggaucagaugcugucucuacaaaaaauacaaaaauuagccgggugugguggcaugcaccuguagucccaguuacuugggaggcugaggcagaauugcuugaaccugggagguagaggcugcagugagcugugacuucaucacugcacuccagccugggugacagaaugagaccugucucaaauaaacaaacaaauaauagucaaaagagacaagucauaaaaaauauaacuggaagacaaaccuuaagaaauauuacuccuaauuguuaucaaauaaguuaauaucaaaacaaugguaguguaauuucugcuuuucaauuuggccaauaaaaaagaagaaacaaaagcaaaacaugaaaaggaaaacaaaacaaaaacccagguaaauaaugcauuaugcugaugaaggagauccaugagacagauacuuaacacaaaucucagaacaugguaucuuucaauaaauguugaguaauugaauauuucauauacagcuaauagugaaauuaaaagcccagcuacauguggaugguuucuuugucucuaaggugggaauagcuauuugcuucuccuuggucagagaugaucacaggauuuuucauuuauuuauuuguuuguuuguuuguuuguuuuuugagacagggccucacucggucauccacgccagagugcaguggcgcaaccacagcucacugcagccucaaccuccugggcucaagccguccucccaccucagccuccaaaguagcaugcaccaccacauccagcuauuuaaaaaaauuuuuggccaggcgcggugucucacacuguaaucccagcacuuugggaggcugagguagguggaucaccugaggucaggaguucaagaccagccuggccaacauggugaaacccugucucuacuaaaaauauaaauaauuagccaggcaugguggcaggugccuguaaucccagcuacuugggaggcugaggcaggggaaucgcuugagcccgggaggcagaggucacagugagccgagauugcgccauugcacuccagccugggcaacaagagcgaaacuccguaucaaaaaaaaaaacaucauuuuuuuuucuuuuuuuuaguagggacagcaggaucucacuauguugaccagacugaucacaggacuuuuuuagccacagucccaacauguuacccagacugugcaggcccagcagccauacccacucugaacuuccucauccuuuucuccuccugaguccagaucugcucccucaucaccuucucaucaguccucacuucauaucucucuuggauuuaagacuguccaaauguaucauuucaaauucucaaacacuacaaagucauagaaaauuaaagcuggaacuuuaaagaucaucucuucauuuuacauauuuaaaaaaugggcuaaaggaagaauuauuugagcaaagccacgcagaaaguaagaggucaaaccaggucuggguuucuuuccaguuuauuguugguggcuuucuuuccacuacuguggccugggccaggagaagggugaaaaaauaagguuguuggcuccacuggaggccauaacuuguuuuaaaaguucuuggaauagucaauucagaaauggugagugacagaugugguuuggcuguauaaaguaauuuacaucaucuacuuacuccauauauggaucauuuuaccacaugauaauguauacacauauucugcauauaugcaaauaaaaugaccaauaugcauacuuauuguaaugagguauagcuauaaaauauucauagaggcaccauguugaauuuaaaaagagcuuuaaaguugagaauuuugcauccuaguuuguuuuuuuuuaaccuauugugugcuuuuugccaaaucaauuauacuauccaggucuacuuuaccaaucugaauauugcaguuuucugaggucauguucaauuccaacuccucucagcuucuaguaaaaaaccugaguauaauuugucaaguuuaccugauugguaguauauguuuucacguagcaaagcuuucacauuuugcugcuucuguaagccugguuguugguacuuaacauuaaaaagucagaacuacuaauuauuuauuucuugaagaaaaaagaaaacauuguaacuuuucuaaaaugauucggugugacaugaucaccagagugacaucccauuacuuuugccacauuguauugguuagaagcaagucacagguccugcccauacauaagggcaggggauuauacaagggcaugacaacaguggccagaaauuuuggagaccaucuuagaauucugcuuacuacagacugucaugaagaaagcauguuugcagacauaaagaagagauucuuacaugucauucaacauacugucaauucuucaaguuuauagauuaaaccccugaaauaacuuuuuuaauacccacaaagauacugucucuucacuugguauuaccccgccccccaccuaguuacuagugguguuggugacaaauucuaaacuuuaagagccuuuuuaaaauaauagcucuuugcauuagcuuagugccaaguuguuucaucugaaauugcuaaaucuugaagauuuuuuucauuuuaucaccuuuuuuccacugaaauucaugauacuaaauuccacauaauuuccccuauauucaccacacauauuuuuucuuucauuuaacaucaucuucuuaaauuugggcaugcauuuccccaaauuuugauucaauuaugguuuuccaauacauuuucaaaauuuuuuaaauuuucauuuauguauuuauuuauuuuagaaaugggauccagcuauaaugcugaaauuguucccaaacuuauaaguucaagcaauucuccugccucagcuucucaaguagcugggacuauagggaguuuuccaaucuuuuaaauaauauuuuaaucaaauuuuuucauguaucaugcauaaauuagaugaaaguggaacuucccugcuugaauuaaagccuucagccacuuaaggcuggagugagaucucuggagaacauuggcuggaaacaccucuucugucauauuaguaggacagaugccuuucauugcaacauacauacugaauguugguauaauuguugauugaaauuuagcuguacaacuuaugaucugcagaugauagacuuucucuaaguucuaaaguacauuaaagacuaagcauauagcauuuuagaaauaauuuauacaaauuauguguuuaagcuuaaugccuuucuuguuuuuauaaacuuacuaucaucuuugagaaggucugggugacuuuuauauuaauguuuuuauuuauuuuaaucuauugacuauguaaaagguuuacuauuuguuuaauuuaauuuuaauuucuguauuguauuccuuauuuaacaugccaaucaaaacucuuguuguuccccauguuuuggcuaaaaacaguuuaguucggucacuugugaacuuauuuuauuuuguuuguuuuucuuuccuuucuuacacuaaugcucauuuauuuacauuauauauaaauuucuagaaaaagcacuaacacuucucucagguuaucauaguuuaucuagaguaauucauugacauaagccccacugcuuaugguuuaaucuuucuaauagucacaugucacuuuuucugauguuauuaugauuugaaaguaggggaaaauucuucuuacuauuaugagaaucagggucuaucauaaggguuagccaugauguggcuuaccagccucccuuugcaaaaugcugacuugcgaaguagagcuuaagccaaauaugaauaccauuuuuuaaaucuaauuuuuaaucauauauuguuccugaaagauguauacacuucucuggaucccaaacauucaacugcuccauuuauuuacaaaauaaaaaugacauguauaaaaaugucacuuuaggugccuuguuccagcauggguucauuguuuggagugcuacaucaauguuuuagcaugagcugcacuuguaauucaucaucuauuauuucuguuuaguuuuuuuuuucccccagaggacaaauaucuuaacgaaucauauaaagcaaccugaauuuaguaucuucucagaaauuuauauuuguaacuauuuaaaaaguaaauauucacaccuaauuuuaugguuuuuuaauguacauguaucuaugugggggauuuaccgguguuacguuuauucaaugauuuugacuuaguuuuuauaaauacaacaacacuuuuuaaaugcauuuuucaaauucuacaagauuaaauuacacacuuacaguauuuuagaauaguguaaauugauuugaaaauaaacauaacuuauucuugauaagcauaccauucagcuggugaaaauagaaaugugcagauauccuaggcaguagccaacgaccugagcaauuuuugcacaucaaggucaucaguuauuguauuuuacugagaaaacugcaagugucauuaauuuuguaaguaaguccauuagaaugaagagaaguuauaauaaaauauaugcccaaaguagucccuguaaaguguugaaagggguuuaaauaagagagcaauuauuacucuuccgcaaugaugggaggaaaaaucacuaggagaaaaagucagagaacauuaagaaguucaccuugggccgggcgugguggaucacgccuguaaucccagcacuuugggaggccgagacggguggaucacaagaucaggagaucgagacccuccuggcuaacauggugaaacccugucucuacuaaaaauacaaaaaauuagccgggcaugguggcgggcgccuguagucccagcuacuugggaggcugaggcaggagaauggcaugagccugggaggcggagcuugcagugagccgagaucgcgccacugcacuccagcguggacgacagagcgagacucugucucaaaaaaaaaaaaaaaagaaguucaccuugauuaacauacagcuucuaucugugaaagacaaauuugggagauuugguuggaacucuaaguugaaaacaaaaacuucauccaucacuaauaucugaaacagagguauucaucuauucauucauucaccaaauguuuguuagucauucaccauacauacacuaagcuuuguggaccacaaaggucuaagucacaugaggcuagaaugaggauggccauuuuuauuuauaguuaaacaaagaaaagguaacaagaauaaacagaaauuucauaggaauuuggaaucugacugagaaaauaguuauuucagagauaaaauaaggaaaacugacuuuugauuacugccaauguuugaaauaaguaaaaguaaacaaaaaaauuugagucugggugcugaaagagugauauugcagaaucaggaauuugguuaaagaaguauguuuaagauuguuuaaaaagucauuacuuagauugagagcauacuaaauuugaguauuauuaggcacaccuccacuuuccuacaguaguucagacagacuguagaauauacuuauauugcuuaaaaaauguuuuaaaauuaauuuguaaacauguagaagaucacuugucuagaccugcgaacuuuccaagugcagauauuccauuggaaugcuaauaagggcauuugaucaucuuuuaaaucaccuuaaaauuucugaaauauggagugacuccaagcucuaugcauuaaaaaaagaaagcacacuuagaaguauauuguauccauccauugugacuaucuuuggcuuugccauuaauguuuuacaauuuggagaaguaacacuauucaccaauuccuggaucuacagcccacccauggucccaguuuguuuauaaaguaguccucaugaaauagcaaaguuauucagaaacauuuaacauauuuuaaauauaagauaauuuagaguucauauuaucuuguaauguucauacaaucauacaguucauacaaucuuauguuauuaauauccacuacauucuucaagaguuaccaauguaauauggguacuuacaagcgcuugcucauguacuuaaaauuaguaguaaguuuuacuuuccuaacauuuaguagacaggguagaguucguguauguccaauugcaugccaacucuuauauuguucaauuuuccauuuugauguuauucucauauuguguuacaucaucauuacacuaucuugguugaguaacucaaagggauaaaauaggaauggaaaucauauaaacuuaaaacucagguuuuuuugugaauugagacucuaaugaaaaaacaucagaagaaccauaaaucuacauguauuuuuaaaaaguaauucuguaagagugaccaucuuagguaagcauccuaaaaauaaaugucuaaauaagaaauauaagaugaauaucugaauauuaaaacuuauugaacuguugaucuauuugucuucuucagagaaugccauuuugaaaaugugucaaaaaguaacauaaggucuuuuggguucucguaauuuucacagaaaauagucacaacuuagguaagucagauaagucuuugucuuagaaaaaguaaaaaacaaugcuuuaauucauaaagugaauaagugguuucacuuaaaggcagaauaaaaaucaaugcuucagagguaucauuaaaaguaguauuccucauaagaaaacaaauaugguuggcaaaaaagcaaaacuaguuauuggcaauacuuuauuaucaguguaucaguauacuuuaauaucaugcaauaacaauugcaugauauuacuaguaaucaaggaagaacaauuuuuauguacauguucaugccaggaucuaauucaccuuacaauuggauaaaacacuuaugugcaaagaaucaaucauuuaucuguggcacuuacaugaagauuaauuacugagcaacuuuuuguucugcuuauuacugacaaccuauacugaugaagaguagauuuuuaugcuaauauucuauuauuuugugagucuugguauagacuggaaaacuauguggggaucagaccuagcagauaacaauuauauauauagaagguagguuugcuauuauaauucuuuguaccugaaugccucuccacacaaauuuauucacaggaaauaauauccuuucuaguucuuaauuaauuuuggcgaaaauuguuaaaauucucaaauuccacucucuaauuguuucaugaagaaugggcauuugcuuuucuacagugaagaacaaugggugaugaaauguugcucacaugguuuuuauaaaguauguaaugaauuucauuaugucccggauagugccaaucaaggucauuuuuaaaauaugaaggcacuuguugaagugacaagucuuagccuaucacuuuacggccaaaugaugaaucuguguaauguugaggauaagacauaagaauuucuucagaagaucaugugauguuaugaguaguuugauugagaaugugacuaacgccugccacuaggugauucucuucguuugucagaggaagaaaccaaugacuuauuccuggauauguuuuaaauucagugcaaaugcuagaacagaacacaaagauagucaaagcuaaaugcaacccgaaaguagauuaugaucuauuuacuacugucuaucauguugaacaaucaacuuuucagcuucugagcauaguaugcaggccuauuuaauguguuagaauguugaaauuagucuucagugagaaauauuuuauaauuucaaagaucaucuucaaccugaauucacagagcuaugacagagcuacaugccauuauagguccuaauuuucuguaacugucagguaaguuuuucuauuuuaagaaauuaaaaggaaaggaaagaaggcaacuagauauggacccagacauauaagcuauccuucuucaagcaaauacaaauauuucggugaaacuuuuacugaaauaucaacacucuccuauguaugugaaauucauauuaacaauuuuaauauuguguuuaauuuuuacuauuuacaauaucgugauaacggguugaauggcuugcugcugugugcacuggaaugccuauugucgggucuacauaagccugaaguuuagaaaauacuguacuagauuugauacuccaauaaggacaauagauauuucaguuaucagugaauacucagcugguagcauauuguugguguucaaaaaauauuaguugaauaaauuaaugaauuaauuacacuugccaaaaacuuauaagccaguuugcuggucuucagaaagagcgucaugaguuuuuccuaucuuaauauguuaguuaauauuuucuauuaucucugccaucuuugucuucugagaacucuagaaagagaaaugugcaucccaucacuauugucaaaauaugaaggauauuguuauuguuguuguuguuuaacuagauuuuguucuuucagcuucacauggcacauuaacauaaacaugauuugucagaggaaacugaauuuucccacacacuauuuaucucauuuuacaacacuucaggcucuaaaauacuugccagaaauugaagaugucuauuuaauaucucuaagguuguuuauugauguaauuuuugacauauuuuauaacaauuucucuccaaaugaccacauuuauaguaaauaacucugaacaccuuaaccaugaaucuuaguaacauaagugaaaacaacagguaguaucuguacacacagguaagacauuguuaaagaaauauguaaagucaaacauuaaacugcagaauaaccuaacgacauuauuuucuucuaagguaagcuuucucuuucucuccugcuccuuuucccuuucucuuccucccucuucucuucccuguguccccugcuucucuaauccacaaggcaguguuuugcucaguacauguggcugauggccuuuuguaaccucauaacauagcaaucugauuucaagcuuacauugugaauuaugguaaaaggguuagcacagacaaugauuuucuuauuucuuccccuuauucaaucucucuuuuucucuaaaaauaucucuaccucaagaagaauaaaaaacaaauucauaguaauaauccuuucuuggcaggcaacuuauuaccaaaauuaaaggacuuuacuuucuauguccaucucacuuacagaaacugaaugaaagcaguagcucaucagaagguagcacuguggacaucggcgcaccuguagaagaacagcccguaguggaaccugaagaaacucuugaaccagaagcuuguuucacugaagguaaagaaaagaauccuaauguuaaucuuucauuuggagugcagcuuguuuagcuguuggucagcuaaaauaaaucacauauaauaaaauggcacuuuguaauagauauaauucaaucaccucuaauauguugacagacaaaaaaacuuaaagucuagugucaugcuuugauuauaucugcccaauauguggaagagauuaagaacauggaggaaaaauauuuuaguaccaucaaaacuucuaacuuauauuuuuaaaguaaguagugauuucacaauaaguuggcaucuuagacacuacugaaaaugauccuacacagaauuugccuuaaaaguaacuuucugacugcuaaaacuaaacggauugcuagugcuaaauuguguuucuuuaaugaaaacaucaguuuccaauaauuguuggaugaaauggggaauaaauacugcccuagaaacucuauaccuaaacagucacuaguugagccuggugcaguaugggcaauagauagaagagauauguuuuuccuacaacuaauauuuccuguggucugauaucccugggaauuugagguuuggaaauaugcauacuuucuauuugauguuauuuuuucauaggccuaguauaccuucagucuucuucuauucccuauacaaaucaugcauaucacuuaauguccuuuucaaaacugcccucaucugaccaugguggaacagcagcuuguuccucugaauggcuguaagaaguauuuccauuuaauuuacccgauaauauacauuauccuaugaaaacucuuucucuuuuugaacaguuacauguuacuuuucuaucuuuuuucucuucuuuuccuccauuccuucacuccuuaguuccuucuuuccuccuucccuucuuuucuuccuccuuuucuccauucauucccuuucuccuuuuucuucaaacauaucuuuuccuccuuuuuuuuuuuuuugccuuggagcagggauccuguauuuauaucuuuuucuuuuuuuuuuuuuugaaaaccagauuuuuuuugguaagguucuugggaguaagguacauguucggugccuuuuuguguguguaccuaagugccuuugugcuuacaaugguacucagaaguaccuguugauugcauuuagacuaagugaaagcaaugugugaggaaggcaaugaaaagucaaagccaaaucauacaaauuagcuuuuagugaacuaaauuaauuaugcaaauuacauaagcccuucuaggcacaucacaaaaaauccuaaaugguaacaaaugcagcauuguuggaagagaucuacauuuuuacucuauauccuuuauaaaagggaaguuuucugcuuaacauuauuaauguccaauuuaaaguucuuuucuggagugacuucaacagagugcaacaggaugauaugguacaaggaaaagcuaccucacauuuauuuguaauuuacaaaguuucucuuggacaauaacacugugaggcagacaaagcaaauacuguccgcuagggcaucauuuaaaguggcugaauguuuccacaacuucacacagcugaugaaugugcucuuacuacucuaggcuuagagagcuaugcuagcaagacagagaugagcauaguaauaaaaagacaagacaaggacauugcuaaaggauauuauggaagcagagacacuuuaucuacuuuuauuucaacacuuucugcaggcuguguacaaagauucaaguguugucaaaucaauguggaagaaggcagaggaaaacaaugguggaaccugagaaggacguguuuccgaauaguugaacauaacugguuugagaccuucauuguuuucaugauucuccuuaguaguggugcucuggugagugagauuaagaaaaggugauacagcacuaauuuuuagaacacucuaauacugaugacuuauuaauccuuuguuucauugucuuaguauccaaugcauuuuuaauuaucccaccuuguaucuucuauagauuuacucuauaacucuauauuucuggauuaacuuuuacuauguauguaaauauaauuuuaagaagcuaaucauuaauuuuugcuuacuauuaaauagcccagaaaguguagcccuucagcuuauucauuaacaccaaaggaugugaauauucaauuacucauuguuuaauuaaaaaaaguuauuggaagcccugggaugggaauauauauucucugaguucugacgaauuuuguuucuaaaugguauuuauuauuauuaucucuugauggacaguaguaaguccuuagggaccacuucucugucuuuuuccaauugugugcucacuauuuuugugcuacuuaagaaauaaugaaaguugguaacaauaaauauugggcagcaugcccaagagauucauuuaaggauggguuuaucuuuauaacaagguguucacuucaucagaaucaauuuauuuuuauaggaaaauuauuuauaaaacuauaaauaaaacauacagauagcauuuuagggaaacacuaacacaaaggaaauaccauagauagaaaaagagaaagaaagagagagaaacagaguuugccugauugaaaugcaaguguguuacaaguuuaacuuuuuauaauucuaacacagacauauauuuaccuguaauuuuucugaagaaagaaauauuuucuacacgcuacuuuagaagucuuucaccguugaaaggaaugcauacuuagaagugaaacaucgagagguucauaauagaagaauauauauuagaaucuaaaugaaaaguaauuucauuuaaucauugucacacuguaugucuguugagaaacauaaauuauuaaaaaaauaacaaacaacaacaaaaaagaagcagaugaacccaacuauuuagucaaauuggagacugcgaagaucaaucacaauuucugcuuuacaaaagcacaagcuuucauuauuucuucaaccuccuuucuauagcaaaaaaaaaaaaaaaaaaaaaaagccaauagaaggaagcaaaauaaaugaaacaaaaggaauacauaacuucaaguugggauggccacaucaggauacaacaucaagaacuauuuccugacuaagucaaauuaauucauuggaaucauacuuuucuuuuucuuccaccaauagucuuuccccugauuaaauaaguaaaagaccuuugcgaggaaaaaaaaaaaguaacaguaacuacuguuucucugcccuccuauuccaaugaaaugucauaugcauaugauuaauuuuuuaaauagcuuauggaguauaauuauuuuugaaagcuaauaauguguaacauuuucuuuauaggcauuugaagauauauauauugaucagcgaaagacgauuaagacgauguuggaauaugcugacaagguuuucacuuacauuuucauucuggaaaugcuucuaaaauggguggcauauggcuaucaaacauauuucaccaaugccugguguuggcuggacuucuuaauuguugauguagguaucguucauauuuuugucucuguucaagguagcuugucuuauuuauauucaaauucuacaauagugagucucagaccacuauguuauguugacagacuauaauaaccacuaaacgcauauaugcaaugagagugucauuucuggaagacaagggcuaauuuaauucugauuuaaaauaacauugggggauggaaucuaugguaguucucuaguuaucugagaaagcuaaagaaaaaacaacacaucagcaguuuguagggaaaguagugaaacagggaacuuaaaagguauguugcuuaaauccuuuauguugugagucagacagacucaaguuuguaucccaggaccaucacuuguugauuuugugccacugaguuaguuucuuggccccaaacucuugacccccaacuuguacaguauuaaaggcacucaauaaaaacagugaugcuguugggugcuacagucauuuaaaaaaauucuauuugaucuacucaaacuuuuuaaagaguagauuuaaauaguagauuauauggauuaugacuucauuauaggaaguaagguauguagaguguagggaaagagaagucuacuuuauucagcagugaaaguuuuccuagaauguaaacuagauuuacggcaagcccaaacagcccuuuauagaauuuguauccccaaugauuaauacugcauuuacugaaaacaagugacugacuucaagauguguuaaaguuaagcaucauguuuucuauuaucaacuuggcaaaauuucagcuuuagaaagcuacagcaaaacuauccugauuucauauugaguaguuuuaccccaaaaagauacuaacccagcaagacuaugaggguuucuuguggaaaguguuucuugagcuaagaaucaugaaugcauuauauuuccuugacccugaacaaaggcaaaacuaagcuauuuaaaaaacuuaacaauguuacugugaaaugagccaauugagagaaaucucaaaggaagaauugcuuuaucacaucaauaagggagaaaguuuguaauauugagguuucaagcauuagaaguuacauuauguuucaauuucagaauuguuuacacuauaauuuaaaucuaaauguaauuuaacccuuuaaaacuuccugagguuuuuuuucuauuauguuuauuacacaucagcuuuuucaugaaaguuuuuuagugucauuuuugaaacauuuuaagaaaauaauuuuauagaaaauuuuguaguuuguaacaauaauaucuuuauuuucaauguucuguuuuaauucuuuaaugaagaucaguauagcacucuauaaaaggacuaauuacagcacaucucaaauaauguaagaaguauauuaaauaugauacaauuaauacauuuuaaaaaagaaaaguuuacaaaaauagugugcaguauaugcggaauucuccaauacuagcaucuuucuaaccaaauaaguuauaaucuuccuugaauacaaaguuuuaguaaauuccuuauuuagagaauuagauacguaagauuuuuccuuuagucauguauauuaccuacaaaugaauacaaaugaaguaaauuuauugcuguguguauuugguaaauauucauugauuggcccuuuggggccagauaucauggcagaagccauaaauuaguauaaaaaauuuugaggaaguuuuguaauggaauuucuuucuaaguuacuuauguaaaaauaaacaagugaaaaugcaagguauuaccaagacaaaauaucaccuucaaaacugauguaguucauuaauuucugagaauaccaauuaugauuaguugaauauacugaugcacaguagaaacuuccugcuuuuuuuaguacaacagcaguuuuuguauuuuauaacuagcuacaagaaaagccuuaaauucaacagcaacuuaauaaaauaaaggaagaauagccaaugaauuuuuuuccaccuugauuucuucuuuuauuuuacuaauuuuuacuuugcuuuuuuuuucuauuuauucaguugauaaauuauaugacauuuaaggauuuuuuuucaacuagcuuuuaauuaauguccuaaaaauuacauccuuuacaucaaacugaaauuauuucuuuaauuuuuuaaagguuuacugaaaaugucugaacauuuauccucugaauaauuauaagcaaaaauuauacuuguuguauuauauagcaacuacacauugaaugaugauucuguuuauuaauuguuauuauuuuugugugugcagguuucauuggucaguuuaacagcaaaugccuuggguuacucagaacuuggagccaucaaaucucucaggacacuaagagcucugagaccucuaagagccuuaucucgauuugaagggaugaggguaagaaaaaugaaagaaccugaaguauuguauauagccaaaauuaaacuaaauuaaauuuagaaaaaggaaaaucuaugcaugcaaaaggaauggcaaauucuugcaaaauugcuacuuuauuguuuuaucuguugcauauuuacuucuaggugauaugcaagagaaauaggccucucuugaaaugauauaauaucauuuaucugcugugcuuauuuaaaugacuuuauuuccuaauccaucuugggaguuuccuuacaaaucuauauacaaaaaaaagcugaugcauuauuaaaguacuauguguaaugauauaaugguaaucuaaaguaaauucuauaucagguacuuauucuuugugaugauauacuguacuuaacgaguuuuccugaaaauaaugugaaucacacaugugccuaaguaugaguguuaagaaaaaaaugaaaggaguuguuaaaacuuuugucuguauaaugccaaaguuugcauuauuugaauauauucaagauuagaugguuagauauuaaguguugacugaauuuauaaaacuaguaauacuaacuuaaagauuacauacaaauccacaucauuuuuauaacaauaaaguaaaacacuuauaaugaacagaaaauauaauuuugacucauuacuauagguaauuuauacauuaaccuuaacuugcaucuuauuggucagagucacacaaaauguuauuuuauccuuuucaaagaugcaauaaucauuuuccaucaugcauaacagauuagaaauuuugccauuauugacuuauuuuccaugccuuuuuuuacggcaugaagcauuaguuuauagauauauaauauaaaaaauuaguucugcuuuuuuuuaaaaaaaaauauuaucaaaacaaaacacugaauugugugauuccaauagaaaaacacugcucuuucaccuccuaagguguaguuacuuuuauggaaacuaagcuguauuguagacuuccauuugcacuuuguagauuguuuauagccuuauguucucuucucaagucuuauuauaaaugucacuuuguaagaacguaggacuugucuucgauuucccuaacauauaugaaaacuuuguccucauuaucgacaacucagaacaauauaauacaaguaguccucuuuuauuucucacagagagccucaaauuuucaccaaaauguuaacagaaauuaucucugggguguauaagaauuaagucuguuuuccaauuaaaugucacuuuguuuuguuucagacuggcaguuucaguucuggagaaaaaaaaugucauuuguguacauucuacuugaaaacauguugccugaaucaaaauaauauauuuuauauggcuugugaaaucugaacaaugcuaaacauuugaaaauauuauaaaccuuuuacauuugaccauuugaaaguuuauuaaauucauuggucaagugcucagauauuuccauacauuacacuucauuucuauaaaaaagcugaucuuaucgguauacuuuuaauuuucucagaaauaaccauaucuauaauuauuaaucaauaaugccuuuuauauuaaaagagguuaguuuuugaaacuuggaguuuuagacauaaaauccuuauaaaugcugauagugauauaacuaauaguuuaaauggucagauuuaugaauauggcucuauuccucauaaugacaacauacacacagcacuaaaaugacuaaucucuucaauacguguuuggcauuguagagucaaaauaacguuauaauugauucuauuuuuuauacuucuaguguuuggauauuuuauuuuguaaaaauauaaucaugaaugauggugagguuggauauaagaaugaugauuaugauugggaagugagauuugaacaugcucagaaacucucauuuaauucuuugcccuagcagcauaaaaucacaauagcugcgucaaagcguaacucaggcacucauuuuauuuuuguuguucuguuauuuuuucaaagcaugugcuuuuaugcaacauuacugaauaaagcauguuguacagugcuugauaagaaguuagaaaguaacaaauaaauuaucaucacguugcacuuuguguuuugcauguuuuaugcacauuucuggcugacagcuuuuaaacauuuauuguauuucaaauuuccaguccaaauuuuucaacuuguaaaauuaaacugagugaauugaugucgugaauaucuaggguaaaauaaaauuuguguuuaaauuuguauuuuuaauuuccuaaccuaggaaaucuuaaauaccuucuuuuucaaaagaacucaagucuuaauggauagggaaacagacggagagcaucaugaacaaaaaguaacaccaaauguucugucauaucagauuucuaacuaauaacaaacuauauauuucuauuuuguauaggauaaucuugcuccaacuuggaugggguggagcgcugguuccuccccugagcccuuuauuauggguacuguauuaccccuuuugcuaccuuuaauccuugcacugugacuuauguguaguggggugagggagggauugggaaggguacuauuauugcaccacaguagggaaaauacauuauuuacauccuaauccccucuuuucaauugucuuaaauuucauuugaaaaaaaaaaaaaccuuuaugaauuuacccucuguggauuuuaaccccaaugguugauaucuuuauuaaguuucauugaauaugauuuaguuauguguauauggaguuauccaucuuuggggagauuacuggauuggugagggcgggggacccugguguagaaugauuaugugaaaaaacaauuuaacuuguuaagcucaugauacuguuugaggcauacagccccugcuguuuaguacauuggucuggguccugaaaauuaccaguuagauaccaucaguugauuauugauauguaugagcagauacuagggugcaauauuucagguuucauaagacugguauugauugugaccacucucauuuuuuauuguguaaguucauaugggguuauuuucaaaauguuaacaaggcaaaaauauauuaagaaauaguugaauaagcacaugugaauuguguuguaaacaaaaaguuagaauaaaaaaauccacuuauuugaauuaugcagaauagaauacauaccuagaaauaaaacaaaaacgucuuaucaugaguauuaagauaaaauuuaaggcauaaacucacuucuuagaauaaguaacucccaacuaacuuucuaggauuuuaaaacauaacacagugaaaacauacauaaacauaacucuacauuuuauuuauucuuaaaguuuaaguguauuauacaagaagaagaguuuauauucgagagacagaaaaagucagaauuuuuguuuggaucaccaauauaucauagcuuacaaaaaaacugucuuaauuaaaacccacaacauaauuuuuuuagauuuuuaagaaagauucuauuauucuucuuuauacuuaaaaauggaugauuccuacuuugcccacuuuuauuuuuauucacauagauuuucuuuauuucuauuagagaagcacuagaauucaugaauaguguugauuugaaguucaaaguaauuaauucagauaaaaagacauuucugcauguaugaaaauuucuaaugugaauuugcauauuuaauuaucaauccuucauuuaguguagacuuauuuuuaaaaaugcagguaaugaaccagaaauagaauugguugugcuagaguagagaaacuuuauuugaugauuguuuugaaaaaaaagcuucugagaagaaacaaccucuaguacaguauuaauucauuaagauagcuccuuucucagacauuuccuuucauguagccugaaaguucaauuugaaauuuguucuuuccaauuuauucagacuaauucugccuacuuucuuccccccauaagaaccaauuacugcagcuuuauugagacugaaaaaaguuaauacaccuccuucuuugcugaaccaaggaauggcuuggaacucuugggaaaagacaaucuuuucuaugaucuuucauugucuaauuuaauacaucauaaauaugacuauagcuuuguauaauaaacuccccaauacugugccagauguuuucuaagauaaaguuauuuuauguucacaaaaaaaauaaaacuuuucucugggccaaauguaugccaacuuugcaaaucauauccugaagugcacugcugcagaguacaugcuugcgucauaaauuccauagaguucgcuuuaacucuaaaucaauccccaguuucaaaguaaaccucucaaacauauuaccuaagcacaaacuucucccugugcucaguuccuuaauuauucucaucccauauucagaaauaacauuuaaaaauuaugcuuugaucaauaaauacuaaucuaaacuuugcuucauuaacccauucauuuuugucaaccauuauuuuauuccuauauucaaagcucucugguauguucuuauauucaagacacucaaggcccuggaagauucacgaacauauguuugcaucuuaaauuuuuagaaaaucuuacaaucugucaggauuacacugaacucuaguacagaguaauauggguaccagauaagugggagcaacucuuccacguagacuggaaacagcacuaaaugcuauuuauaggcuacuuucugaacuuaacuuguuuuaaccucauuuuucucauaugccaaaugagaacgcaauacugaauuaucuguacaguucuguucaguacuagaauucugauucuugaauucaaaggggaaaacauuccucuuuauuuuggaggcuaaacugggggacaaaguuaggcuccaugaaagaagugcuauuugaacuaaagccuuuaagaggggagaguauuucagaagaggagcuauuagacaaggaauuucaauguaaauggcaucucaaucaccuggcaauuauauuagcacacgguuauuauauuaauugaaguggcaugaaguauagaugaccagggaaguuaaaacuggaaauauagauuguggagugaugugaauaccaagguaagaaaaauauuuguuaguuaccagagagccaauaaauaacuuucaagugggacuuggggaagauuaauucaucuuacauagauuaaaugaaggagaagguuaggagacagaugacagugcaaguaugaaauaacagagggcaguucuagguggugacugugagaauggaaaagagguggcaaagcugagaaacguuucaaagaaaaaaugugagacagguaaugugaaaagaaaaucgagaaauagguauagauaaucaguguucugcucauacucuaaauuggguguugaaggcaaaauacguauuuuaauuaguacucuguguauacacacuagaaacagcauuguaaucuggauaguggacaaaauauucagaaaagaagggaaauaguaacuugauuucaauuuccaaaucucuaaucugaaagaaaucuaauucuauucauccauuuaaaauaaauuauauaacgagaauuuaugaaguccauuguauuaaugcagacagucagaugagauaaggcaaagugucacgugucagcuugguaguugcaucggccacaucauuugguucugccuggauaacucaaccaaauuaauuuuucauacucauccccuccaccuuugucauuacugguauucuuauuuucuuuggcccacuuaucacacuguuuuauguuccccagaaggccuagaguucuuuacaggcuuuaaacagggaucagaaguauaagaaauuggcucauguauuuuuuuuucagacaggcaguuaaaaaaaauuguucuaaaaauacacuggcaucaaauggcaaauagaagauguuuugacgacuacuuccauuggaucagacugacaagaauaauacaagcacauagguggaauuaaacuuagcuauuaauguccaaguuugaggcagcugccccuuauaagcauuuuagggucuguuuuuagcuucccucuuagccacuccugugcagcuccagugggagguauggaggaaaaagcaaggaagccaucccuauguuguuuccaaacaugaacacucaagauuuuuaacuagugguccagaaguaaagagggggaaaacauccuucuauagaaaaaaaaaaaaguagauaauaauugaacacagaacuucaugugaucacaucagauuugagaacuauguauggcaucccucuuuuucuuauuuuccuaagaaaugauuucuauuauguuucauuugaaauaaguuuuuugaauuaaacucaguaaaugaaacaacugacaugacuggagcuugaaauaaacgaugugaugaucuaaugaaauacauaaugcaaauugucuugcuucuuaugcaaaaauuauuagucauagcaaugcaugaauaauuaaagacaauuauauuagguauuuaauaauauuuuuuauauuuaucaucugaauuuuuaaguuauuuuaaaaauauauuggucaaaucaacucagguccaaauguuuuaguuuuguucuuuaauauauugccuuuuuaaaaugaguuaaacuucuguauaggcuuuuuaacuuuucuuuauucugauaacacaauucugacuucaucuggcagcaaguuccucugauuuuccuuuuccuuuaaccuuuuaaugcuucucccucccuuuuuuuuaaaaacauuuuuguuucauuucuugguuauauugccuauaguuguuuuccuaaguguauugcuuaagaaaaaaaaaugaauuuuaagauuuuuuugaaccuugcuuuuacauauccuagaauaaauagcauugauagaaaaaaagaauggaaagaccagagauuacuaggggaauuuuuuuucuuuauuaacagauaagaauucugacuuuucuuuuuuuccauuuguguauuaggugguugugaaugcccuuuuaggagcaauuccauccaucaugaaugugcuucugguuugucuuauauucuggcuaauuuucagcaucaugggcguaaauuuguuugcuggcaaauucuaccacuguauuaacaccacaacuggugacagguuugacaucgaagacgugaauaaucauacugauugccuaaaacuaauagaaagaaaugagacugcucgauggaaaaaugugaaaguaaacuuugauaauguaggauuuggguaucucucuuugcuucaaguuguaagugaacacuauuuucucugaauauuuuuauuguuuggaauaauaacaaaauaaugacauacaucuauuauuuaguuccuaagaaaaaguauauauuucuuucuauuuaaaaaauuucaauuuguuaguacaaguuuaugagcccagaugggugaaaacuuuauuacauguaaggacugcagauauagucaguagugaccagaccaaacaaagaccucuuugucuuuuuucuuguauuuucuuuguuucuauauugcucuuucuauauaaacaaguaaauuaauaaaucaguaacuuugccauuuuuuauugugauuagaaggcuuguuucccugaucagcuaccaaaacggaauacacuuaacagauagaucaucuuccaaaacacauacacuuaauacaccuaauuggauuguaauuaauugguagggauuaacugcugcugaguucuauuauuuggaucaaaguuuggggaaugacauuuagguuuuagaauuagaaccaggcauagcggugggugccacugcacuccagccugggcaacaaagagugaaacuccaucuaaaaaaaaaaaaaaaaaaaaaaaaaaagagagagaauuauaccuggaagcaacuagaaacaaaaaugaagcaaaagcagcuguugucuuaucucaaaugaccuuucagcaccauuauuuaagucuauuuuguccuaaauauuaauguuuucacuacugggucucuaagacugggucuccaagaaaaauaguuuauaauuuauauuuaaaaaagguagcccuuuaaacauuuucauuugauucugcuucuagcugcagcagcaccacaacaaagcagggaauaaaauaagaguccagauuauuugaaaacucagcuuaaaaaaaaaagacuguacaauuucuuucuucccuugugguucuacagugucuuuagggcagaaaucaauuuuugcucaccaagguuaugauuucaacuguucaaccagaagacuaacuaagcaaacaaaccaacacuggucaaaacccuuuugcagcucuuccagaggugucaacuaugauuacuuuacaaauucuucccaccuuuuuguuggaaauucuuauuucucuucuuaacauuuuugaucuacucugaauaauauucaugcaauuaaaauagagauuuuuuaaaucugguaagaacggguggggcaugguggcucaugccuguaauccuagcucuuugggaggccaaagcuggaggauugcuugaggccaggagaucuagaccaguggaggcaacauagugagaccuugucucuaaagacaaauaaaaacaaaaguuaaaaaaaaucuagcaagaaugcuuucuuuaaaaauugucgacacaugaugauauuuauuugggcacuuauucuaacccuuaacuaaugaccauacuuguaaauaucacuaaagcaaccaccuccuccauaaauuugaggaaagaaaaauuaaaaauuuuaagcaauccuuuaaaauguaagcaauucugaaaauacagugaugguccugcacaaagcuauuaaauaaauucugccaccaaaaaaaaaaaaaacccucuaaaauacugcuucacauuuggcuuuuauagaaucaccucucuauugauuaguaagucauugaaauggucccuugaaucacuuuuuuguuucuauaccaaguguguaauggaauuguucuaucauugaccuaagccacugacauauuuaacacaucucucucucuuucauauacaaaagccuuguacuuucuagcuaggaaucauuacuuucuuuucacugcugucacccacacccuugcuuagcuuuugucucaugaaauccaccaccucacaaggguuagcguuaucagaacaaagauauauugugauacagacgcuaaaggcuuugcuaaccucccucacuagcuaagggauaauccuuuuaggcccacaggacucaaaauucaugccccaggacaaguaacaaauuacuguaaguuguuagccugaguauccuucauccugugagugccaagugucugcuguacuauuguucacauuucuuauucauauuaacuuauuaucuucaagaauuucagaaagaaaauagaauaggggguuauuucuaaauguuuugaugcaaaauucuuaaaaggauuguauuucuaaauguuuugcuccaaaauucuuaaaaggauaguugcaacccugccuuuauguauccugguacuauccuuacauuguuacaauaaagagaaaucuuaaauuuucaaucacuuugaucacccugcagauaaauuuuagcagaugauccuuagaucuaaguuguaauuauuuggcugauagagcuauugacccauguguuggcauuuguaagacuuucuaaaaagugcuccagcaaauuuuaauacugcuuuaaauaucaugacaccaugaacucuaaagaauugaaaagugcuugugaguugguuaucaaggggaggauauaucaaauggccauuuuguucaauauguguucuagaaaugaaaagccauacuaaaauacugucuugguccaaaaucuguguaaaauuuguuuugaaaugucuuucaaaaauauucccuuuugaaaauuauaucaguaagaauauuuauuaaacaucaggucuaaauuauuuuuacuccaaaguaaaacaugcauguccuucuuaauaggccacauucaaaggauggauggauauaauguaugcagcaguugauuccagaaauguaaguauuccuuguauucuaagucuuuuuacaauauugaucaggugguaaaauuaaucgaauaaagcauaaacgaccaaaugaaaugauucuaucuugauuuaaaauauuugggaaaaagugugacagguaaauauucaagcauagcaauguuuaucagaaagaucuuacuaagauaauucaacacaugaauuauuuugaaaaccaaaguaacaaauucauguauuuaguaacuaacaaauauuuuccuuuuaaauauuuucuauuuuguuuccuauuuauccacacauuauauaauuaguaguaauuuuagugugcgggaccaaauuugaagaaauauaugauuucuaucauuaguugaaauguauagucacccuccauauuagacagcaugaaaaguuauggauauuguucugucagccuuagauuacugugaugauuucuuucaaauaauccuauuuuaaaccauauaaaagaauguuuuuauaugauuuuugcauucauaaauugacuggagccuuuacuaauguugcaaucacuucugugaccaacagauuccuuuaaguguauaucaccaaaauauaaaccuauuuuauuugauuucagccucuuucaggcuccaagaccuaaacugaaauucaugcucauuccaacuuugcucuucaaaacuuuguaagauguaguauuuucuaucaaccuucaucuuucuauucucaagucccaucuguuuaguuuaucaucauaaagaauaaccucugucccugcagucuucaaccugauagaguuugauguuaucuuucuugaagugcauuucaaauagcuuuaguuuuauguugaauaucauuuugauaaccuccagaguuguuuuauuucacuuugucacuuauauuuuguuuuguguguuuaguugguuuuuaacuuuguugcuuuuagaaggacaugaaucuguuaaaaaacuauagugaccuuucaguccauuacuaaauuauaaguaauagcccauuuguuuuaagcacaaucuaggaauuaaauaaucaacugaggauuuauaaaauggacuguccaucuaugucuacuuaaucugaaaaauucaauaacuguuacuuuaggguaaagugccaaacaucugaaugaacaacucauuucuuauuugcuacauuauuucaugcauacaugaaugacuguuucuaaaccuagccuguagauauuuacaguuuuaaauuuuuuauuaauaauuuuaaaauuacuaaaauucaguaccuuaaaagcuugcaaauuuagcacauuacuguucaaauggaagaauauuauuuguauuuauaguuauaaaaauagauuuuagaaugucauaauagccauauuuuucacaugaaaacaucccuaaaggccaauuucagggauguuuuuuagagguaguugauucagaaaaaaaaaaaaugcugacauauuaguaagaauaauuuuuucuauuguuaugaaaaagcaccagugacauuuccagcacuaaaauguaugguaauauuuuacaaaauauuccccuuugguagguggaacuccagccuaaguaugaagaaagucuguacauguaucuuuacuuuguuauuuucaucaucuuuggguccuucuucaccuugaaccuguuuauuggugucaucauagauaauuucaaccagcagaaaaagaagauaaguauuucuaauauuuucucucccacugagauagaaaauuauuccuuggaguguuuucucugccaaaugaguacuugaauuuagaaacaaaaugggaguauauauuauaacugauuuuuccuuccucuuccucugucauucacuauccauauauuuccggcuauagaaagcuaagaauaacuguguuccacacucuuguucauagguucauaaaguuuuuccuccucuuauucauuaucaagaaacauuuucuaucuuuuaaaaaauaauaauuagaauaaaacuagaaagcaaccgaauaugccucuuucccaaaagcaauuuguuacuuuaucccuacaacuacccacucccccuugaaaauauauuuuccaacuaauucuuugcaauaaauuaggcacuggauguaagcuucuucuaguguuuauuuuuacgcuuuuuucugucauugauuucuuuuauauauucccauuucuuucuccaagauauuuaaauacaagcuauccguuucagucuugaauuguaugacuauuauuuaucauuuauaaggcucauuugauugucccaauuaccuauguacauuauagaacauauggaaaguaaauaaauaucaucacuuggaaguaacugcugccauucacauuuuguuuucuguucagaguauuucugcacauacucuuauuguuguacuuuuuaucuauaauuauaaauuccacuuuagacuuaacauaaguauuuucucauuuuguuaagucuucauauaugcauuaucauaauuuacuuauucauuccccaguagguugauaauuuagauuguuuuuaaucuuuaaugauuuaaauaguaccuuguugaaaguuuuguacaaaaaaaaagagagagggacagaaaauaaggcuuuaauuauuuccugagaauaaauucccacaaugaaguauuuuacuccccuagaguaauauaacuacucaaacucccaauaucaguguaugaacacccaugccaccguucccucacugucaccaaacauucuguuuuugaauauuugauauuuaauaggugaaaacuguauuuaauuuuaauuuuuaugacuuuuauaaccuuaauuguuaugacuuuuauguauuuuauuacauuugaacauguucuuaaaugcucauuggccauuuguauuucuuccuuuauguacuguugcuucaucucacuuguucaguagguuugcuuuuuguauaaugaaugagugcuuucuuagacuacagaacauucuccccucaauucccuuuucuuauuaccaguaguauucuuaagucaauaucaggcuacucuauuucacuuacuugccaguguuccaaucuucuaucccuacuggucugucccauacuuacuaugcuaugagcucugauuuauccccuaaaucucucacuaacucauccaguuuucuuuuuaucccuuuccuccaauucuugacagaguuagagugacuuuuuuaaugaguaacuccaaacugucuugcaguauacauccucuaacucuuugcuacauuuaaauaagaaaauuauugccuuuaacaucauaaagguaguauguauaguauaagguaccaaguauuuauuaucucagugaaccaaauuucgccacucacuaagcauaaggucuuggguaaaauacuuaaccuuuuugagauuuggggguguuugucuucauaagauaauaauaauaaagucaauuuugaauuauuuagggaauuaaauauuaucauaccuaaagaguacaauuuuuuuuacauuuuaaaucccagauauaauuauacuaaucaguugaauuuuguauuucuuuuuuuagccauccauuuucuauuuuaacauugaaaaaaauguacaaaaggacacaguuuuaaccaguuugauuuuucuuuucuauacuuuggaggucaagacaucuuuaugacagaagaacagaagaaauacuauaaugcaaugaaaaaauuaggaucgaaaaaaccgcaaaagccuauaccucgaccaggaguaagaaguaucaaaugauaugggggaaaaauacaaaaacaaaaacuugcaugcuugucucacaaaaaagaaaguagcuaacauuuccaguagaaaaaauuucuuucacuuguagagcaucaucuaaaagugauguuuguaucuuuuaugauaaugguaacaacaaaaaaaauuaaagaccaaaaaagaacaagaagaaauagaagauacacccuugacuucaagagauuuagaagcaccccauuacaauccauauuaauuggccaauggacacauagacaaugugaugugcacaagagaaaguuaaucacacaacucaagaaugguugccaaguaauaucagggaaagaaguaaaccuugggauggggcuguaagaaaugcaauuuccuaauauuuuaagaaaugaaguguugagugaaauaacaccuuacuucuauuuuauuuuucacuagagauacuaaguguuuuaaaggaggaaagaauuccaguaucuacuauucauauguauggcuauagaguuagguauuacuaaugucugcagaagucagggucaguaauuacaguuuaugaugauaaauaacaauacucaugcuuccaugaugaaauaaacaaauugcuaugaaaauguacagcuauuaucccacacuauaaauauuuuuaugaugaugaucugagagguuucaguaauuccuagggugcaucaaggaaaaaacuacuagcaaauauucauauugugaugauugaauauugccuuccugagaaugaugagaaauauauacuuucuccauuaaaauuuagcacuaagaguagaaaugaaacaacaauuuaggaaaaauauaaguuggaaaauucccucagaauuccucaguggcccaaagaaauaagccugcagauggccuucagugacuagcaguggcagaaaugggaagcagaaucacagaucaacgacaaagaacgugaaguuuuuuuugacauaaacauauaggaaaugucauucuggucucauuauccuugugcaguuucaggauucugugucugacaauguuagccaaggcuauuugguagaagaauaugaguauugccauaugugguauuuaaaugcauaauguuauagaugugucuuggaaauuccaaauucuccuuaacaauuauuugagaauacaacaagugaaauauuaauaguacuauauuuuaaaauggauguaugguccagcugaucauuggaaagucuugaaaaaaaaauuaaauggguuucuuaccuuuucauaaucuuaaaauguugauauguguugcauaccucuggaagaaguauacaguguugaauguuucuuuuguuuguuuguuuguuuguuuguuuguuuuuaucagaaaccuucuuuggauaagggauuguuauucugagaaauacacauuaguaaauggcaauuuaaauaacuaaauuuuaacaauuaauaugcuauaaaucauucuuacaaaaaucagggccaaugacuacuuugcaagaaacuagaaagucaauuaaugcagaaaguacuuaaugcuaaugcacaugagaaaacuccuuuguuguuaaaagcauuucuauuucucuacagaacaaauuucaaggaauggucuuugacuucguaaccagacaaguuuuugacauaagcaucaugauucucaucugucuuaacauggucacaaugaugguggaaacagaugaccagagugaauaugugacuaccauuuugucacgcaucaaucugguguucauugugcuauuuacuggagaguguguacugaaacucaucucucuacgccauuauuauuuuaccauuggauggaauauuuuugauuuugugguugucauucucuccauuguagguaagaaauauuuaaaguucuuaaauucaguuaaauaaaagugaaagcugaaacaaucaagauuagauucaagaucaucccagcaaucagagauaaucacuguaaauauuuugauacauuuuauccaaguguguuuguuuuuuuaacaaaaugucuccuacuauaugucaguauuguuucuuauucuauccauuuagaacaauauacuuaguguaaauguaguaaaaccucauucauuugaacuagaacugugcuauuaacuaaaauaaaaauguuuuugacauguugagauugaagaaccaauauaguaucuagaugguucuguuaacaagacuagaaauguagucugguacucacgaaaauugcuuuagagaauagacauggagucaccagcauauagauauuaguggaaagugguuucaagauaaggaaaaguauugcauaaaaagagaauaaagacaaggacuaaacauuagcaaaugcauauaguagguucucugcaagugucauguagagauuuucuagacuaccuuaaaaauggguuuaucauaaugaugcacaagggaaauaagguggcaugggacaucaucaguacuauacuucaaagccuggaacacauaacuagccucaugagcaauagcucauuucauuagacaaaacuaaagcucuaguaaaguaaaaagcaucugucugugggccuauucauucuucccuaaacaggaugauaugauugggucaauauuuuacuauccaaaacgaggcaccuguguuggacagauuuucaugccacuccccucucugaagaaacuggccuuauauccagcucauuguauauagccuuugauucccacuaauuauaauccuugguuauaacuaguguggcuaagguauaaaaguuguauucucacacgucuccuucucucucucucucucucacacacacacacacacacacacacacacacucuuacacuucgucuuuucagaaugaggcauuuaaacuugaaggcauuuaguuucuugagcucuucuuuuuaacuuuacaaguauuguuuuuaucuaaaaagcaaauggagagagaagcugaaaauaagaagacugagauuacaguguuagguacaggagaccaaaaagaauugaaauacaacauuaaguacaggauacuaaaaagagcaucaaccugggauccuuucagaaaugcaccagaacauacauaaaugaguauauaaaaauauuagaguggaauuuaaguaaguaccaagaucauggggagaugaaaguagcaucaaaagcuaccaauacuuucagauggaaaaggaguaaauagagaauuuagaauauggcaauuucagaaaaagucacuguauacauauaaacuuguaccuauacuguugggcugcuacuguucggccaaaugugcauuuuuaacuuauuuucuuuuuaaauucugacuugggacuuuacauaaacuaaaaguaguuuauaaacaucucuuaaagauaaaaaaaaguacuauaauccuuauaauugaaauuauugcugaauuucaaaauuaagauuuauaauauauuauguacaauuauauauauauuauauauaguugucauauuuaauauaacuggguucaggacucugaaccuuaccuuggagcuuuagaagaaacauauguuuauuuuaacgcaugauuucuucacugguugguauucucauuguuuauucauagguauguuucuugccgagcugauagaaaaguauuucguguccccuacccuguuccgagugauccgucuugcuaggauuggccgaauccuacgucugaucaaaggagcaaaggggauccgcacgcugcucuuugcuuugaugaugucccuuccugcguuguuuaacaucggccuccuacucuuccuagucauguucaucuacgccaucuuugggauguccaacuuugccuauguuaagagggaaguugggaucgaugacauguucaacuuugagaccuuuggcaacagcaugaucugccuauuccaaauuacaaccucugcuggcugggauggauugcuagcacccauucucaacaguaagccacccgacugugacccuaauaaaguuaacccuggaagcucaguuaagggagacugugggaacccaucuguuggaauuuucuuuuuugucaguuacaucaucauauccuuccugguuguggugaacauguacaucgcggucauccuggagaacuucaguguugcuacugaagaaagugcagagccucugagugaggaugacuuugagauguucuaugagguuugggagaaguuugaucccgaugcaacucaguucauggaauuugaaaaauuaucucaguuugcagcugcgcuugaaccgccucucaaucugccacaaccaaacaaacuccagcucauugccauggauuugcccauggugaguggugaccggauccacugucuugauaucuuauuugcuuuuacaaagcggguucuaggagagaguggagagauggaugcucuacgaauacagauggaagagcgauucauggcuuccaauccuuccaaggucuccuaucagccaaucacuacuacuuuaaaacgaaaacaagaggaaguaucugcugucauuauucagcgugcuuacagacgccaccuuuuaaagcgaacuguaaaacaagcuuccuuuacguacaauaaaaacaaaaucaaagguggggcuaaucuucuuauaaaagaagacaugauaauugacagaauaaaugaaaacucuauuacagaaaaaacugaucugaccauguccacugcagcuuguccaccuuccuaugaccgggugacaaagccaauuguggaaaaacaugagcaagaaggcaaagaugaaaaagccaaagggaaauaaaugaaaauaaauaaaaauaauugggugacaaauuguuuacagccugugaaggugauguauuuuuaucaacaggacuccuuuaggaggucaaugccaaacugacuguuuuuacacaaaucuccuuaaggucagugccuacaauaagacagugaccccuugucagcaaacugugacucuguguaaaggggagaugaccuugacaggagguuacuguucucacuaccagcugacacugcugaagauaagaugcacaauggcuagucagacuguagggaccaguuucaaggggugcaaaccugugauuuugggguuguuuaacaugaaacacuuuaguguaguaauuguauccacuguuugcauuucaacugccacauuugucacauuuuuauggaaucuguuaguggauucaucuuuuuguuaauccauguguuuauuauaugugacuauuuuuguaaacgaaguuucuguugagaaauaggcuaaggaccucuauaacagguaugccaccugggggguauggcaaccacauggcccucccagcuacacaaagucgugguuugcaugagggcaugcugcacuuagagaucaugcaugagaaaaagucacaagaaaaacaaauucuuaaauuucaccauauuucugggagggguaauugggugauaaguggaggugcuuuguugaucuuguuuugcgaaauccagccccuagaccaaguagauuauuuguggguaggccaguaaaucuuagcaggugcaaacuucauucaaauguuuggagucauaaauguuauguuucuuuuuguuguauuaaaaaaaaaaccugaauagugaauauugccccucacccuccaccgccagaagacugaauugaccaaaauuacucuuuauaaauuucugcuuuuuccugcacuuuguuuagccaucuucggcucucagcaagguugacacuguauauguuaaugaaaugcuauuuauuauguaaauagucauuuuacccuguggugcacguuugagcaaacaaauaaugaccuaagcacaguauuuauugcaucaaauauguaccacaagaaauguagagugcaagcuuuacacagguaauaaaauguauucuguaccauuuauagauaguuuggaugcuaucaaugcauguuuauauuaccaugcugcuguaucugguuucucucacugcucagaaucucauuuaugagaaaccauaugucagugguaaagucaaggaaauuguucaacagaucucauuuauuuaagucauuaagcaauaguuugcagcacuuuaacagcuuuuugguuauuuuuacauuuuaaguggauaacauaugguauauagccagacuguacagacauguuuaaaaaaacacacugcuuaaccuauuaaauauguguuuagaauuuuauaagcaaauauaaauacuguaaaaagucacuuuauuuuauuuuucagcauuauguacauaaauaugaagaggaaauuaucuucagguugauaucacaaucacuuuucuuacuuucuguccauaguacuuuuucaugaaagaaauuugcuaaauaagacaugaaaacaagacuggguaguuguagauuucugcuuuuuaaauuacauuugcuaauuuuagauuauuucacaauuuuaaggagcaaaauagguucacgauucauauccaaauuaugcuuugcaauuggaaaaggguuuaaaauuuuauuuauauuucugguaguaccugcacuaacugaauugaagguagugcuuauguuauuuuuguucuuuuuuucugacuucgguuuauguuuucauuucuuuggaguaaugcugcucuagauuguucuaaauagaaugugggcuucauaauuuuuuuuuccacaaaaacagaguagucaacuuauauagucaauuacaucaggacauuuuguguuucuuacagaagcaaaccauaggcuccucuuuuccuuaaaacuacuuagauaaacuguauucgugaacugcaugcuggaaaaugcuacuauuaugcuaaauaaugcuaaccaacauuuaaaaugugcaaaacuaauaaagauuacauuuuuuauuuua

SEQ ID NO: 5 - RNA, 159973 nt, Homo sapiens
gaaacucauggaacuguuccuccagauuaacacuucagggguuauggaagcuggaggaagcugagcuuuuacuacaucuuuuggggguaaauauuuuugcauguuucagcaguuuauguacuacagucuuggcagaugccugucagucaugcugagaggugcagggagaaauuacugagauuacaguucugucagcaugcuugaauaagcauaguaagucuuccaguaauccuggcuuugagacacuuaaggaguaaauaaaucauaaauucaaauuugcuuaucggacaucaucuguaaccaucaaggaaugaauguugauuugauauuuaaacucugaauacaauuuauuugauuggagguguuguaggagagcauuauuagagguggcuauuagcucaaagagauuuacugcaguucuuggcuguuacguugcccuugucucuggcugcaaauuugcuucccuuguaagugaguuauauauaugccuguauuugucuucuguugugauuguuugugaucguauaagaauaaacuggcaguuaggugacuucaacaaauaaugaauccugccuacuuaguuucaaggugaauacugcagcaaaagcgccauucgacacuagcacugaaggaggguggauuaacugcauuggcucaaacugugcuguguuuaggagacuugaagggaugauuccagguuugauaugaacaguuguucacucuauggguaaaaguagaaacaauauagcgcugauucuguuuuagacucucacacuguguccugccucagcaauuaguuaaaauagcaggcucuuuauugaaugcugcagaaaagccuagagagguagcaggguaagauugccgcagcagagugauauauuggccaggaauuuuaauaagauuuaaccagauaugauaauacaacagauggcaucuaaucuaaaaaauagauggauauuuaaaaaguugaagacaaauguagcacauuugagaggguuuaucuuccuguguguccuuggcaagugaaguucaguaccuuggacaggaugacaugaguuaggaaaguaaagucugcauaaacugucuacgugaucucaaagagcaaaauggaaaguuaacuaucaaucauuuguuuuggugucucucagugaugacuggcauuaggcagguuacuuagcacauacuuucuagguaaacagguaguuuuaaaguaucuaaaauuucuugcauuuuaaaaauuaaauuaaaggaaugaaaaugagugaucguaaaauaaauuccccugaagguacuuuucauucuauuaaccauauuaacagcagcacauugauuauuuaugaugaaaauauaccacuuacaauuguaugcuguauuuaguugauuaaacauguacaugauuucccaaauaauuuaaagagacaauuauggucccucggggccugauuuuauauuacugaagucaauaggcauuuucccuagacauagcuugagauaagagccccaucagaccagguuuuacucaguuuggcauucagacuauuccucauaaguuaaaaaaugauggauacauacuuaauuguacuuauaaucuuugaguuuauauaucuuucagauaacaaugucaguguucaaauugucuauaauugauuugcauuuaauauuguuucuuuuggcuauugcuaaaagggauucuucuuuguuguaauaagcuuaaaauauauuaauuuuuucauuuuaaaauggggaauuugaauuaaaugagguuuaaauuaguuuugauucuaccauauauaucuuuguauuccucuaaaugggaauuaacauuauuaacuaaucuauguuaaagugagauuacauuuuuuggugagauuauauuguuugaauauuuacaauauuaagccaaaauuuacuaaguaccuacuaaauucuaggacagugguuuucaaaguggggucuccuaaccagcaacaucaguacuaccugggaacuugcuaggaaugcauguuuucgggccucaugacagacuuacugagucagaagcucuagggauggguccuggcaaucuguguuuguguaagccuuuccuccaggugacugugaggcaugcugaagucugagaaccacugugcugggaaguaauuugguuaaauauuauaaaaaugguuuuuacuguauauaguuaaauacauauugucauuaaauuuucuauguucaucuuugccuagauauccuacuguaagcaguacuauguuuuaaagauuuaugcaauuauugaguauaccuuaagucuaaauauguccauaagaaggucuauuuuccaacaguuccauuuuagaacuuuagcucuuagaaguuaaauacuguaaugggaaaaauacuagaggacuuaucuguuuguucacugugugauuuggcacauaucacugacccucuuugauguucagcuucucauuuauuaagaugagagguuggcuuacaucaggguuucucaacucaguacuauugacauuugggucagauauucuucgcuguggggucugucccagacauuguggaauuuugagcaggguccuugccucuacccacaaaguguccauagaaacccucaguugugaugaccaaagauauuuccagacauugauaccugucuaccaaaggcaaaacugaccuccuccucauuugagaaccacugaccuagauuagcuccgcuaugaaaaguuccaucauaauaaauaauacaacaaauauaucauuuauccuuuuggaaguagguagguuaaaacuuauaaauaaaugaagacauguuuuacuuguauaacucagguauaaggugggaccuguuugcacccuugaagaucuaggugacgaucuauugguagauaucuguuggcagauaucuugcucagguaucuaccaauaccacagucaguggaaguccaaaaccuucugcaacuuaucagggacuuagucuuacaucauccucuguguccuggcaucgugguuucauguauacuacaccuaaccacucugucaagugacccagugucugucugucccuaguuuuuaacagagacuuaccuacaccaaucaccuuuucaauuuaauaaauuuuauuaaagaugugggcuucuacccgcauuuucucccuuccccaucccaucucugcuccucauccccucccugagagaucugaacacuccaaauuuuucucuucuuaguauggaaaguaguccaucucuccacagcucuuauauccagacguagaugcccaaacucaucaaagaguuuagaagauaaagggccuucaauuuagaaccauucaccauacauagaaggcaguuggggucauaugguauaaucauaaaguuauaaaaucauaggcuguuggaaggaauauugaauuuaaguucauuuucaugucuuuagccuuaaaauuacaaauguuacaagcuagagucucagaauuuuaaauuauaccuucccaugaauuuuuaccuaaaccacuuggcaauuuaguacagacauuuucucgaccugauaugugcgauagaaguagacaagccucacacacaugcaugugcgccuacacacacacacacacacaaauuuuucuccaacaguuaaagauucuuuucaauauacuauucuacaauucaaauuaggugcuauucugagauauauguggauuaaggaaccuaauauaagauauagguagcuauauuucuguuaaaauaauaauaccucauacuugaaugacuauauauguauuuucaaguaauuuuaaaaacaugaucccugccgggagugguggcucaugccuguaaucccagcacuuggggaggccgaagcgggcagaucacgaggucaggagaucgagaccagguggcuaacacagugaaauccugagaucgcaccacugcacuccagccuggacgacagagcgagacucugucccccacaaaaaaaaaaaaaaaaaaaaaaaaaaaaaaauuacuuaggccaggugcaguggcucacgccuguaaucccaacacuuugggagaccaaggcuggcagaucaugaggucaggaguuugagaccagccugaccaacauggugaaaccccaucucuacuaaaaaauacaaaaauuagcuaggcaugguggugcgcuacucagaaggcagaggcaggagaaucgcuugaacccgggaggcggagguugcagcgagccgagaucacgccacugcacucuagccugggcgacagagugagacucugucucaaaaaaaaaaaaaaaaccaugauccuuucugagacccauagcaacucuaaaagauaggccccauuaucucugucauuuugcagugagaaaauaaaggcucaaggucuccaaaugccaaauucacuucucguuccacuauccuacaaagcaaaacucaauaguucauguaguuugaacacauugguaaguauaauuucuaagugauuuuuuauaaagaccugucucaagagucuuccugcucuaagaccuucagagagauuaccagugcuuuguuuuauuccuaggauuaaugcauuuuaccugacuuaucauacauuuauucguaucauaugcuuaauuaauuuuccgguauauguauuauagaaugauuuuaauacaucauuuauuauacuagucauagucacauguguucuaucacuuagugcccucaaaaaacuccaugggaauaggauuauuacccccuuaagagggaauaauucaaacaugagauugaauuaaauuucccuauacuugagcuuuaccagagguaccacacugaugacccagccaacuucucuguuuucaccaacgaaaaugcagaacauagcaacagaccaucucuuuucacuggcacccuccagugcuugacauauagagagugucaguaacuuuuauugaagaaauacugaaauauuguuauugcuauguaguuccuuuacauuuuggacuuuaccuaacauuaaccacccuaguuaauuaaguagcaacuugcaaaugaggccuggaagaaccaaaaaacaaauuuuaaaaagaacugucugcaacucggaacugcuaaugcuacuuucuuuguuucacuuuauuucacuugagaaaaucucuuuggguuugauacggagauguucucagacuuugaaugugaaaaauuguucccaagaucaaauauaaauuccuccuuuaaaauacaaugucacaaaccuggaucacaaagucacuucccucuuuagucuuaaagugaauacucaagaugaacgugaaugaucuuuuauuccaauuuccaauuuagaauauuauuucagaaaauaauuauucaaaguuuuuugagaaaccuccacauaaagccaaacaaauuuuuaccaaaguaagguaaauucuuugucaacugagagccugaauuagaugauuccucagacuuuuuucuaauuauaauauucuagguaaaggaguuuagcucggcaauaugaccauccaaauaucaaccaaauccaagaugauuagauuuaauagcgccauuuuggagaugcauugauuauugaagauaaguaaaggucucaacauuuuuguuuuccucauuuaccccaaaauacauccuuagucacacaugucuuaggaucuggaauuuguuugauaaaaaugcugaguucuggccaggcgcaguggcucaugccuguaaucccagcacuuugggaggcugaggugggcagaucaugaggucaggagaucgagaccauccuggcuaacacagugaaaccccgucucuauuaaaaauacaaaaaauuagccgggcgugguggcaggcgccuguagucccagcuacucgggaggcugaggcaggagaauggcuugaacccgggaggcggagcuugcagugagccgagauccugccaccgcacuccagccugggcgacagagcgaaacuccaucucaaaaaaaaaaaaaaaaaugcugaguucugaaaaaauaaaucuuucuuguuuuguuucaaaugaaauuauagcucucugauaaaguggcauuccuuuuucuguuuuauauucaacgaguguauuaguccguuuuugugcugguaauaaagacauacccaagauuggguaauuuauaaaggaaagagguuuaauggacucacaguuccacaugacugggaaggccucauaaucauggcagaagacaaaggaaaagaaaagacacgccuuacauggcugcaggcaagagagcuugugcaggagaacucccauuuauaaaaccaacagaucucaugaggcuuauucacuuacuagaacaguaugggggaaacugcccccgugauucaaguaucuccaccuggccucacccuugacacauggggauuauuauaauucaaggugagauuuggguggggacacggccaaaccauaucagcaagugaaacagugaaauuggauuucuaaaaguugucaguguucuguuggaauuauuuuauucagagagguaaggaaaguacaacaggugucaaccuuccauaugaaauuuccuaaagaauauuauuguuaccucaugcugggagaagggaaaguagcagugauagaguguuuugauuucaaauguacagcuucuaguaaaagcauuauaauuaacuuuauaguaguaagcacaaccaggaauauaaaaauauaaaaguuuuggguuuggccuccagauuuaccaaauguugcuuccuaacaauuagccaacccucccacacugacacuuacuuugucuaaauugaguuuuaggagaaaacaacccaauuauaaagacacaacuauuaucagucaaugcccugacaagaaacagauggcuccuccaaacuuguggaaauaaaaagcaaacuauuugguuuuaucuucucaacacgauauuuucauggauuccuugggaaugcgguuccaguuuucccucuuuagcaggugugccaggcccuucugaucuggcugucugccuaccucuccagacucuagccacuuccacagacccaacuuuacauauauccuacauguaucuccucuucuuagaaugcaccuccucuuucuccuccacccucuuugugucuacucauaaaugccucagagaaauuccuagauaaguuuaagacagucuagauucuacuucccagucaacaaagaaaaaaguuugauaauuucuggugauggaaacaguuucuuaugcuguucuggaauauaaaauggugccacaccuuuggagggaaaucuauugauaccuacuggguuaaaaggcacauacccuuccaccugacagauccauuuccugagacuagaucuuaaaggaaaauuugcacaagugggaaaugcaauuguaaagaaauguauacauccgcauuguuugaaauagaaaaaaaaaaaagaaaaggaagaaagaaagaaaauaacauaaguguuuaucaucugagaacugauuaaauaaacuuugguauauccaucuauauacagaacaaaauauuuuaagcaauaauaagugaacuaauuagagauaaauuauguaacuuaaacuagguuuacagccauauauauugugugauguuuuucuuucuuuuuaaaaaaauauuuguggagauggguucucaguauguugcccaggcuggucuugaacuccuggccccaagcaauccucccaccucagccucccaaauuguugggauuacaagugugaaacaccaugccuggugucugguacaauguuauuuauaaaaaaaagaaaaauauaaaacacguauauuucagaugcuuggauauacacaagaauucuaaagaagauaaaaaaaaaaaaauuaacagcgauugccacugcagacugggccugagggaagagaaacuggaaaguuaauuuuuacuucaagagccacucaagucaauugacauuagaaaugugacuuagaagaguagauuggguuugcuugguguaucuaaauaguauguacaagcagggcugcaaaggggaaugggaacacccggggaguggugagcagggcagaauggcugauuuacauguucaaggugcagaaggaagugaguaggcuuuaagagcugaggccagaugugacagccagggcuucucaaacaccaaugugcacagaaucaccuggggaaaucuuguuaaaaugcacuuucuuauuuagaaggucuggguggagccaaagaguccacauuuucaacaagcucccaagaaguggggaugcugccaguauguggccacacuuucagaagcaagguuuuaaaauucugaaaguauccugguuuugcgcgguccgugucuucacaaacaucaagcagagccgaaaagcacuuguuuuuagaaaaugagcugagaaaaaaacaccuaauuaaauacgauguuugcaacaugaagcuuccaccaaaggaagcuuacuguuaaguguucacgaucagcaguucugcuuugcuagcuuuuucauuucuaacaaauuuagacuucuggagauugaagcuuugccagauugaggcaugcuucuccccucacuacucauguguuuaguguauuuguuaacuuggugagaguacguccaaacauaguuauauucuuucacuugcuauggaagauugaagaaucugagacaaguaagaaggaagaucuccauuugccucccucccacccugccacaugcugcccccuaacauguuugacaagaauccaggcuacagacugaucauacaccuaaaaacuaucuucggucagcuacuuguagaaaugucucucccccauuauguccuuauaugagcuuaaugugauguaauccuuagcaguaaagaaagacuauugucuucuguuuguuugccugugaacucgaauugcagagacuuuccaccauaauuuuaauaaugugauauuguggagaguuuuaguauggccuuaugguaagauuagguacuuuggagauacacugcugguuucagaaucacacuuagucaccucguuacugugugaucuuggccaagaugcucaacuacucugagccucaguugccucauuuauaaauucaugaagauaacaugguaauagcaacuauuuuaugagacuguugugagguuugaaggucccaaaauauauuaaguccucaauaaaauuaacaacaauuauuauuauucuaaaauuauucuuagaauuuaucuaaaaauaguacugcuugaauauccauauguuuauuccugagucucuaccugcuaugauuuggcugugccccacucaaaucucaucuugaauuguagcucccauaauucccauguguugugggagggaccuggugagagauaacugaaucgugggagcaguuuuccccauacuguucuuguggugguguauaagucucacgagaugguuuuauaagggguuuccccuuucacuuggcucucauucucucuugccugcugccauguaagaugugccuuucaucuucugccaugauuacccagucucagguaugucuuuaucagcagcaugaaaaugaacuaauacacugggcaauuuacaaaagaaaaacaaguuucuugaacucauaguuccacguggcuggggaggccucacaaucaugcuggaggcaaggaguagcaagucacaucucacauggauggcagcaggcaaaaagagaguuuuugcaggcaaacucccauuuuuaaagccaucagaucuugugagacuuauucacuaucaugagaacagcacaggaaaaacccacccacaugauucaauuaccucccacuggguuccucccaugacacaugggaauggugggaguuacaauucaagaugagauuucaguggggacacagccaaaccauaucauuccacuccuggccccucccaaaucucauguccucacauuucaaaaccaaucuugccuucccaacaguccuccaaagucuuaacucauuucagcauuaacugaaaaguccacaauccaaagucucaaggcaagucccuucugccuaugaggcuauaaaaucaauagcaaguuaguuaccuccuagauacaaugggaguacaggcauugggcaaauacagccauucaaaaugggagaaauuggccaaaacagaggaacuacagacccugugcaagucugaaauccagcagggcagucaaaucuuuaagcuccaaaaugaucuuugauuccaugucucacauccaagucacguugaugcaagagguggguucccauggucuugggaagcuccacaccuguugcuuugcaggguacagacucccuccuaguugcuuucacaggcuggcauuaaguguggcuuuuccaggaacacagugcaagcugucaguggaucuaccauucuggggucuggaggauggugacccucuucucauagcuccaccaagugguacacuaguagggaaucugugugggggcucugaccccacauuucccuuccauacugccuuaacagagguucuccaugagggccccaccccugcagcaaacuuuugcugggcauccaggcguuuccauacaucuucugaaaucuaggcagagguucucaaaccccaguuuuugacuucugugcacuugccggcucaacaccacgugggagcugccaaggcuugaggcuugcacccucugaagcuaugacccaugcacuauguuggccccuuucagccauagcuggaauggcugaggcaaagggcacaaagucccuaggcugcauacagcaugggaacucugggccuggcccaugaaaccacauuuucauccuaggccuccaggcuugugaugggaggagcugcuaugaaggccucugaaugcccuggagacauuuucuucauugucuuggggauuaacauucagauccucauugcuuaugcaaauuucugcagcuagcuugacuuucuccucagaaaaugggauuuucuuuucuauugcauugucaggcugcaaauuuuccaaacuuuuaugcucuguuucccuuuuaaaauugaaugccuuuaauagcacccaagucaccccuugaaugcuuugccacuuagaaauuucuuccaccacauacccuaaaucaucucucccaaguucaaaguuccacaaaugucuagggcagggacaaaaugccaccagucucuuugcuaaaauauaacaagagucaccuuugcuccaguucccaacaaguuauucaucuccaucugagaucaccucagccuggauuucguuguucauaucauuaucagcauuuuggucaaagccauucaacaagucucuagggaguuccaaacuuucccacauuuuccuuucuucuucugagcccuccaaauuguuccaaccucugccuguuacccaguuccaaaguggcuuccacauuuuugggaaucuuuuuagcagugccccacucccaguaccaauuuacugaguaguccauuuucaagcugcugauaaugacauaccugagacaugacaauuuacaaaagaaagagguuuauugaacuuacaguuccaaauggcuggggaggcuucacaaucauggcagaaggcaacgaggagcaagucacaucucacauggauggcagcaggcaaaaagagagcugugucagcaaaaucccauuuuuaaagccaucauaucugaugagacuuaugcacuaucaugagaacaacacaggaaagacucgccaccaugauucaauuaccucccaccagguuccuccuacuacauaugggaauugugggaguuacaauucaagaugagauuugaguggggacacagccaaaccauaucauacacuaccauauacuaggcacuguauuaaggguuaggguauuaaauagaaucuuuuaucauaaagauuuuuguucaucucuguaaaauauuuuagacacauguguuuugcuuuuuaaacaaagaaaaagagauguuuuuagagauaagaugagacacauuguuauuuuccccaguucccaccagcccuucacaacugccaaccuggaaaaaacauucccagagcccaacaaaugcuggagcccuggaagaagggcuacuagcaggagcacuggacuccaaggaaugcagaccagggaagagaguguugggaguauuaaaauguagguuagaaguggaauaauggacaaguagagggaaagacuuucaaguccacuuuccagggauugagaaacuugggguccuucauccguuggcuuugaaugcagcccaagacaggcauuagcagaaaauuggagagucuccccgaccacaccucacuuccuagcuuaaaaaagcagcugcauuccucuuuaguuaaaccucucaguugggucuucuaaagcucuagcucucaccggaaucuggugccacuuucacucuugccuggaauggcauuggcucucucuauugcuaguuccugggcacucaucaaccaucuuaacccacuuggucaauaguuucuccauaauuauuuuuauuuuaaccauuuugaauguaccaucuacuuucugcuaggaccaugacugcaucugagguauaauuuuaaagcaacaaaugguucauggaaggguaacucuguuugugaugcccaagagaggagacuuagggcagauagagauacauauaaagcuacugcuguccuagagagcagagggacaagaaaaggggagagagaacacucauuagcaguuguguguguguagcauaacauaacauauauauauaugcauauauaugauauguaaucuuagaaacaacuaccaugugaaguagagcaaaugaucgcugaguuucauccuugcuaagagcaugggaaaauccacauucuauguuugcuuaguugcagaaagaauaagggaagcagaaacgucaggggucacauccccuaugugucaauuaaaggggugcagacucagaagguguccuuaccuacuuuauuuagccugcucuuccccacaaagaugaggaauacaggugacuuugaugucaugauagcaaucagaauguaaaagagacuuucaaaaagaccuagugcaacauggaaacaaggacuuuagucucugagcuuccuuauguaucaagugucauagaaaauguugagacaaagugguucugucauuucaacaacccauaaugagcagaagaaucuguuugccuuucaugccacugcagaugaacagguaugagagacugcacuuaggcaugaaagugccgcugccuagcaccucuaucccaugcucacauccgaaucuucucagguguggguaagacaucucaguucucugcuauuugauaugaauaggggcaaucccagaagcagcaacugagcucaugggccccaaaauuuccaaggaaucacgaggagaacuaggcuaaaugucauuauuuucugaccuucgauguaccuuuucccuagucacuugccaaucucuucuaaagggccucagucccuggaguggacccuaaugauuucuguccauuauuuggccuagaguagaauucuugcuuuucucaaggaaagaaacaaaaagaaaagauguaaccaaauguaauuuaugugaguuuguaaauugauauccgaagauuggaacugcauacagaugugucaaaaauguuaauuuccccaagaaauaugguagcaccuaauucuagcgacacuuguauacuuuacagauggcuuugcugugcuccugguaaagucaaugacuuucugccuuugaacaugaaaggaaaaagauguugacaggaauucuuuagggaaacagaaacuacauauuugcuuaugcuaaguuauggcaaaguucaguuuuauucuguaaauaaagcguugucuucauaaauaucagcuauauccuuuagaguaaagaaaguccucuuuauuaaaaaaaucuaauugaaacucuucaauagguaggcaagugaggugauugauauaaagauauacuuaaguggaaaauugguauucgaguuccaauaaguaaucaaucauauuguucuugguaauagcuuuuguugauucaucuuugcaagggaugucgggggguaggggggauugcugaaugaaauaaaucaggaaagaacccaagcauuauguuuaacugacuuaagagcaaaggaaagaacacauaaacacagaauagaauccacacaguaacuucauucuuuaugauugcucaggcauuuucauuauuugcauuuauguuuauuuucucuuuauccuccuguggcaauagauauggagauaaugcuuuaaauauugugauguaccuugaucuuuucugaagaaccaaagcuuuaugaaaucuugauacauuuaaaggagggguauaaagcucaggcaugugaaauguugaauuuugucuccccauaugacagauaaccaucauauaaaugugguuuauuagacuaaaaaaguagaacacauauuuuuagauuacaucuuggcauuucaaagaaaguauagaacuucaagauaguuugcuuccuggauauuuucuggagcugucuuugggccugcauuccugaaagcugucaaugcuacacucugcauacccagagcucgugcccuugggcuugaguacuuugugguuaauauuuaagaaccgcauguggagcuagauugaaggacagucacuuucuuuauucuuugcuaaaaccaauguugguuaguccaucaccuucuuaaacaguaacugcauucauacccuucaucacauccaucucucugucaaaacaugagugaaaaucaauuguggcauaucuagaaauacuucacucacuuccauuuugcuucuuaugugcugauguaccuuacucaauauuaauuuccuuuagaguuaaacugugggaaaacuugaauggaccuuugugguauaaaacuaucuaugugaccuuggacaagucacugcaccucucuuggcaucaguuuccucauauccaaaauaagaacacuugccugguuuaucucugagacuuuuccagcuccacaauuucucaaugauuagcaaaacccuaucgauaaagcaaugguaaugauuuauguaaauugacauucuuuuuuaugagguuuacaaaguuauuuuauucuacuccaggguuuuguuggaagucuauuacggaauuuuuauucaucaauacucagcagauguuaucagguucucuccagaaacuaccuuaauucuaccacagacuugggauauguuuggggaacaaugacaaaaaaaauaagucauaguucuuacuuucaaagagauuauugaguggggucagaccguggagaggugcaccgauagaggguggaggaagaugcggucaaagaagagaagguccugaaaacagaggaaacaaaggaagcggaacagugaaggcauaauggcucccugcuuguuuaggaaaaggcagaguuuguuguuuugaaaaacgacauuuagugucaucuucacuaaauauuaauaaugucuucuuacacguuagcuaaagaagaaaagaucaaaaauaaaccaggcccccaaauaauaaaggauuuaaaauuaaagauauauacagagcacuauaguaauuuuugaagugcuguucaguuggugauauaaucagaggaauaaugcuauuacaucaagugauaaaaaguaauuuugugauuuaauacucauucugaaccuauauuguaaugcuaaucucaucagaugauugacauucauauacuuaauuucccuuugagaaaucagguucauguauuauucugucuuguuuauaaaagcuacuuauuugguuuaggaauauuguuauuucccucuccaacaccaaugucugccuauguaauugaaaggaaauugcagugaaucuuccaacaaggaguaacugcuucccugaaauaaucaccugcagacauaauucuggcuucugugcguugucucgauagcagggaaggcagagggcaacuggggaaucugauuaucuccaucauaaucccacaacuucccuccuuucucuuuugcuuuuaauuacugcauuguggugaguuaagaaaagccuauacuauuuuuucuucuccacuaccagaaagagagagagauaacuggcauucucucucuaaggauuuuuaaaauacuuuuaauaaaauuuuaaauaguguaaugugugcccacaagcacauugguucuaaagauacuucaaaaauacuucagaaucaaaucuguaagaaaaaaaaauucaauuauuuauguucauuauauuacaagugauuuaaaaacugguuaucugugcaucaaaaaaugcaagccuauagcagcucugauucagugaauuccaguugcggggaggggaggagcccucagauauuuuuauaucauauuugaaaaaaauggcugauuauuauuuuuuuaauuuauggaauguauggacuuuaccagaguuucaaaaguccacuuuaguaccuauaagauauuuugaaaucaguuggccaauucuugccaucaaaaaauuguaacuuuaaacuugcagaaaaacuaguuggcucuaguccuaaaagagaguucuuaauugcaguuucugcauuuauuugucuaauagcaaauaaauuucacauucauuucugacucccuuucaaaagggcagguuaaucucaaaaggaaauauaugaguuuaucauuuucggcuaggauaugguuucuauuucuaaaauaguggcacaguguuggugaaugcuuugugagagcaaggaauugguaguagauuuuugcagaaugcugcauuuaccaaaagaaaaaaaaaaaccacuaggaaauugacaucuacaaaagcaaaguacuuaaguaguaaauuacauuuaccaaggaucacaucaguagugugcuuuaucugauuauuccaaucaaaagggggcaaagucaggauuuguagugauacagugguccuguagaucuaaaaucuuaaggucugaguuuaaauccaaacucuagcauuugcuaucuguguugggaucacuccccgacuucaucagaagaccugcuaacaucuagacuugucuguugucaccaccaucuccuuugggauaccaccucaagguacucaaguucgccuccagccuccaauuccuuuccugcggugggaagagaggggagacccagcuucauguugcucagugacuauagauucccaaacaaaugacaggggaauuuagaaacauuucugccuuaaaacucaaaugucauuuauaacucuaaacaagggaaucuggaacucaaaacauaaugauuuggucaucacuuugggaaauuuuuggcuaaaaauuaagaaugguuuccuucuccuuggcaggcauaaaguuaauuaauaaauucucuucauaaggcagcugguuaaaguuucagaacuccacaacuccaggagauacacauuugaaagaauauuuuugauaaccaauuaccuuuauuuucuaugcaagaaaauauuaaagaauauucagauacuaauuacacuaauuccucagccuucugauaaugagauaguucucucuuugaacucuuucaagaucuaauggcaucgagagacucuccuuuaugucguaaaacuaacagacaaaauuaccuggcccagcuuuuuccaccugagugaccucacgcucucuuuaauacccaaaaucuauugacagagauuaugucccauuauaauauucccuuuuauguuuuggcacugagcagugcaacugacagagcuauaacaaaguaacaaccacauucacaggacagagacggagucuuacagagacggagucuuacaaagacuaaaugacaucuuacgccuucauucucuuuuccuuguuaggaacucucauaaaaaagccacagccaugcccccucagccuguuuagcagguucaugcauuacagauugaaguauugucaccuaggaaguaggcagcuaauuuuuuccagcuucugaaacaagauuacaaagggguuccuggaauggcuaacuuuaccaacgggggcagaggaagauuaguuuuucauuuuuugaaguuggaaacguaacagugagaaagagacaaaauuaucucucaauaaauuaaucuacaaaaaaauaaauaaaaugcaaagcugguuccacagggaguuuacauucugggagccaaauaagauacauauauaaaacucuuagaacaaggucaaaugggauaaguguaguagugacauaggguagcacagaguuuuguuuuaauaucuucugcuaacuuuaaaaaauaaauaugugauuuuaagugcauauuacacuaauuuaauaaaaaucucauauuuugccuuuaugcucagucugaaacauggaagauuuaaaguuacuaauacuguaaaacugcuucagcucugacgaaugaaguaucuguguacagaaugaugaguuguuaguuaauaguacucuuugggccaugcuugggauauuggccuuuucuaggagucuguaugagaauagucauuuaucuccuuaugcucaaugcuuucaacuugucaaaugaccauguuucauaagauacaacauaaaauuguucuauaauuaacaaaagaaaaaagaauucuaucugcugagaaaauagaaaagacguuggagaagagagaauauuugacccagacauuuaaaauauccgccgaauuugcuauguguagauggaugaaaggucugccaagagaagugaagguugugaacaaagacauggaggcggaagaaagguagugugcacacugaaugcguugugccuuuccauaugacugacaugucaauguaaacuccacaaagggaggguuuugaucugguuuguuugccgauguuacuuaaguaucuggaaaagugccuggcauauaucaggugcaugaagaagugaauaaaugaagugucagaugcccagaauaugaauaauacuugauagaugcaguacuggcaacuuucuugaagcuaaugaagugguuaggacuccauaguucaacagaaaccaaguucacuuaagcaaacauggaguuugaguuuaucaugggacucaacaucaagaaaguguuuggaucuugaguagacuggagauggaaacagucugucucugucuuuugucacuucuuccuccacaucuguguggcuggcugcuauuucaguauccugguccaccugguccugaguccccauggugagggaaagcugacuccauagcugccagaaucacauguaguggcucucuuugaccaggucagcugcguagauacccucucuugcuccaguccucuguagcaagaggguagguuuaccacuaaggaucaggggagaagaacuauugggggaauuguuaagagcagacacucagaaaaauuggcaccuauaauaugcaauuagaauucauuaaaacauguggccagguauguucuuauuuuguguuuuuacauaucuaaucucuaaguacuauucauauggaauguauuauucuaaaaaaauugccuguuaguucaugcaguucccacucucuuuucaucucuaacaucuuggcaaucguuuaccaguuguugaucaccugucuccucaucuucuuucaacuuugcccugacucuaccagauacugggcaacaucauuucccagacauugaguaacuucaaaugaauguguucaugcuacuccaacuggcuuuugggaaagcacuggauagaguuuuugagcuggaacaggaaauuaucuuacuuaauuucuuucuuuuauagauaaaaagauggauccacaagauggacccauugguccauaauuaagggcuaguaaauguuuuguaaacauagaaaucaaaauuacuuuucugugauucuagaacaggaaaaaauggugaacuuuuagguauguugcaaagaacaguggauuauucuuugggcucuugggaccaacagccuuaguuuuauugcuuugcaagcuauguggucuugaauaaaccucaguaaggcucagaaagcuucaguguucucaaguauaaauaggaauaauuauaauauaauaacauuaauaguauuuaucucaccauccuguaauaaggaagagaaggauuaaauauugaagguuauauugauaaaugauaaaacacaugcaaugauuguaauaaguguguuagauggcaaaagaaaaauaaugaggaugaaauauuuacuuccaaugacuaaucuacacauaaucgugauuuuauguaugacugaauguuuaaggcugauuccauuuuagaauacaauauauaacauaaaaagcucuacucucaguuccaagaguuauaauuaguuuggcauggauuuuuauugucuuagaaaaaacugauauucaugguuuuuauaauucuaucuuuggguaauaggcaauuggacucucuuucuauauauauuugcuuauuaaaauguguuauuauaauuaagcuuuaggcuguguccacaagaugggaaaacauuggaguaaaauauaguaaaaccauagaaauugagaguggguugaaagucuuguuuaaucuguaauuacagaugaagauaguaagaauguaaauguccauagaagacuucaguggcuuuguuaaaggcauguguucaucaguguugaaguaaaacucacauuuugugacucugagcuguucacuauaauaugaaaccuaauccuaaaacacaauauuaaaacagaaaaaugugaagccauagaucuguaauaaagggccaccugauuguuuccugguggaauaaaaagacaguuuuauuuauaagauauaucauuuuuauagauaacaaugauucauauuaggaauaaaguaacaguuucaaacuaaaauaaugcuaaaguuuuucaaguacuacuugaaaauagcuauauuuacuuucaaaccuuuuccucuuugagucauuagguucaugauauuauauagcaauagggaaugaaagagaagcaaggagaagcaauacugggagauuacagagaagaaaggaaaaaaggcugagagaaaagagguugaggaagaaaucauaaaucuggauugugagaaaguguuuaauauuuagccacuagauggcgauguaauguaaggugcugucuugacuuuuuuuuuuuuuuuuugaaacaagcuauuugcugauuuguauuagguaccauagagugaggcgaggaugaagccgagaggauacugcagaggucucuggugcauguguguaugugugcguuuguguguguuugugugucuguguguucugccccagugagacugcagcccuuguaaauacuuugacaccuuuugcaagaaggaaucugaacaauugcaacugaaggcacauuguuaucaucucgucuuugggugaugcuguuccucacugcagauggauaauuuuccuuuuaaucagguaagccaucuaauuguuucaucuugauuuuaaguuuauucauuccaguuauuccuuuggaaaaagaguccauggaaauucaguuugggcagagcaggaaguccauuuuuguauguguauucagaccaacugucccccuccucccucuccuccucuucuccuccccuccccuccccccuccucucucaaccuuccaugaacugaaaucagguuuguuuugcaguucagcauuuugauagaagaugggauucuuuggccugaaauagcuuggcaucuggccaguucuugccuuugcuugccuucauccuauucaaggucccuuuugauccuguugaagcccccuccuucacuggugcuuuggaaguggacuagcuggcugggaauagaggucauauuguucuuaaggacggagcaaaaauuagaucucaguuuuaacuccacaggaagaaagaaggcagcggggcugcugcuggagccuagcauugcagggguauucagcuuccugaggcugaggcugggcuuuugagaagaaaugccucaugccuugaacaaggaaggggcaaugauuuccgccccccaccucugccaacuccuauugagccacacuaaaaaagagcuugagcagagugguaaagaguccccuuuucuauccaaugccaaauaggaaacauugacuuacuuuuacuuagacagaggucacaaccagcaaugauacugcagauacugcucaguuccuagugugaaccgucuugcuuuucagaacagcauaagaauuauuucugaguggaggugaggcuuguccaaaugucuuugcuaucauggauuuccugacuccuaccuguuugagguauguguuuaaagacccgacccacuugcugcauuuacuucucauuucuuuuuguucucuuugauuacucacuggugauuguuaacaaaucggucuggagugguggguaugugcuuuucaccuguccaaugcaacaauuaagucaaggcaggguauauuacugucaauaugugcaugugacuaaauauuucugagugcaguagcaaacuugcaaauugccaauugcuguugcuaucacaccuauaaaaugugucuucuucuucuauggauuuacagguucacgugguauuucugaugcgcuaguauaguaacagaacauauuucuccaaaaagcacuuuaaaucaucccaagaggauguugccagacagaaauaggaaaauuccaugcugagguuggugauuccugcuuuaguuucuccugcccagagaaguggguagcuuaccuuuccuauuugcugcaauaccuggcacgccagggugaugcaacugggagcuucugcacguucgcggggcaucugacauucuucuuucccucagcugugcauuucaggagaaugacuguggugaaaaacucuuuuaaaacucucuuuuaugauuguugcuuuuguaauugcaaugaagcaauuacaaaaucacaucucucuucuaggaggaguuuugcaauuuaggccuuccuucacaaagcuccuggaagagauuuuuagcuggugucuauuuuaggaacauaauguguagacaggaaugaauggccacagagauuuacgggaaaccaauuucuuggagagggugagguaacauuauaaaccacuagaacagagcacaaguggcugguuauaucacauggacccagcaauggaauuaguuuucauuaaacucacuguaacucauuuguguggcuguuuuuccuccuuccuucacauuguuugucuguuuuguuucaaauaucuauauaggaggccaggauacccagaguguucauacugguaacaauaacacauuggauuuugcugccaauacuaauagacuugguuuacaugcccccucuugcugggaaaugugcugucuggagagucauuuauuaugguaauuucucuuuaagacauggcaggagggauuguccaucuaugggcuggggcaaggcggggcacaauuggaggccuaguuaauuauacaguauucaagaaggcacuaaggagcucagucaggauucuguuguaccaaccagagauaccaggggcaaccagaccgacuagauacccaaaguaaacucuaucaccaccaacagaggaauccaguaagaaacauucuaguuccuuguauagaggguacuaucagggaauccagacaaucagagaggguaaacacaagagcaccucaucugggaauugcugacgaagaagagaaaaucuggggcuugcuugguguuaccucuaggacgucaccaaccaggcauuucucaaggguuuaugucggugugagccugacagugacacacaaaagcaucccuccaaaauuuagccuggggaccuugaaagguauugcuuucucccugggcaguuggagaggcugaaccuacuauuuucucccuguacucgccaaagggcacaaagccuacucucuuccagcuaccucagaauggggagggugggagaaacagaucccagagaaggaugggagagaaucagcaauugaagguccuguauagucacccucagggucaauggggcugugcuccgugagguuaucacuuccuuuuuaaauucuaauuagugaaugaagcauguuccaccgcucaauugagauugcauuaguuuaggguagggugggaagaaauuuauucucauugcacuugugaucagaaaaauaaguugugacagaauuccccaagcugccccaaaguuugcuuuuccaacuuuuaaauuuuguccacauuccuagauuuccauuuauuaauuguuuuauuuaucaaaaacauauagcauuuacucugugccagccacuauccuaagcaguacuuugcaaauaugaucucauuuaauccuaugagguagauacuauuguuaauuuuacaggugacaaaaccaaggcacagugagguucaauuaacuugcuggguuauacaguuaguaaguggcagaauccaagcaguccagccacaccguggccauggcgucuguguucuugauguuugcucaucauccaugugaugguagagcuacagcuuagccaagagacucaggacugaaguugggugcagucguacaugugagcuguaauucaucugcuuucugacaugccaaaauuccaaaaacaguuugguuuagaaugauuacccaaauccacuccauuuguuuguuuguuuguuuguuguuuuuuugagacagagucucacucugucacccaggcugcagugcaguggcacguucuuggcucacugcaauuucugccucccggguugaagugauucuccugccucagccuccccaguagcugggacuacaggcgagugucaccaugccuggcuaauuuuuguauuuuguagagaugggguuucacuauguuggcccggcuagucucgaucuccugaccucaagugaucugccugccucagccucccaaagugcugggauuacaggagugagccaucacaccgggcuauuuguuaaaaaauuaaaaaaaaaaaagcucuccuguacaauagaagauagaagggucugcguucuaagugcaggaauguggugaauaaagcaaaauuccuacccacaugcagcuuucagucuggugauagaguuggacaguaggcaaaucaaugugcaaagaaaugucaguaaauguaaguucuuugaagaaaaauacugcaagauaaagagauagugaggaugagaggggcaugcaaacagaaaauaaugaaagagguggagaaaaaguuuuuuuaagcagaaaucuaaugaggccaaugauggauugaaucaaaggugcuaaagggugaagugccucacagguaugaagaguggcacaaaccuugugggugauccugaaaguaaaagaaacgaacagaaauagcaccauagaggugugcagccagaucuguggaaucucagagauugggcuuagggcucuaacugcccccgacuuuuaaaaaaacaaaucaaagaguuaugucaaauaaauuuaaaacauucaauguuaacaaguuauuagguuuaaaaaaaacauaaaucagucauuuucacaaaaaaaaguuuugagaguuuguaaaguucucugaaaaaauguugcaguuccuagaaugcaaaaaaauugccucaaaaauguugaaaagaacugauccaaagguagugaguuaucucaguugauuguucacagucaguuacagaucaaacuccuuguucuacgcuuuccccucuucucacuacugcucuugucuaaaaacuuuuuuaaaaauuaaaaaauauugaaaagguacuauuugaugaaaaaaaaauuguuugaaugagaucauugguuagaaugauauagucacccagucaguuuuucuuccuccagaaaugauacacugaccaggugcaggcaagaaagagacacuaagcaugaaaaccaguguuuacaucccccauaguggccaggacacaggagcugcuuggagggauuugaacaaaucuuuuuuuuuuuuuuuuuuuuuuuuuuuuuuuuuuuuuuugcaaaugaaugaguaggaaugugauuucaaaauaauuugauaaacaucagcuuucauuuucaucuauguuaaaacuuuuguuaccauauuuuuauuccuucaagacucauauuccaaugguuuaucuuuuuauauuuuuuucacuauuugcuuccccucauucucaguuaccuauggacacuguaguucuucucuagaaaaugugaauuugcuucucuucuaacuuagaaucaaccugacauuuuagcuuuucucuguaaauggucaaaagucuuugccuuaucauauugccuguuucuccuuuggugcucuaccuacaaacuuagauuuaauuuugaugaagaaucuacucuaacuuuuuucuuuugucacuugugcuuuuagucucauguauaagaaaccguugccuaaucugaggucauaaaaauuuacuucuauuauuuuucaacuaguuguauaauuuuagcucuugcauuuagaucuaggauucauucugagucaacuuuuugcauauaaugugagguagggguucagcauuacucuuuuguuuguucauaucuaguugucccagcaccacguguugaaaagacaauucuuuccccggugaauugucuuauuaacauuguuguccaugcguuuaugauuuuagcaucaauuauuucuuacaguggguacuagggauauaucuuuuaagaaaaggucagugagauucuuuguucuugagaauccacauaacuuuaaagaaucagaaaacugauccauauacccuuaacuauuaaacacuuuauugaucuaacuucacaacaaaauguuucuucucauuauuggaaacauauucauuugugacuccacugaaaauuuaaggagauaaugagcaaauauuuccagggaaagguuauauuuauuccaaagaaacauauuuacuguauugcacaugcuuucccaaaguuacacaaauauuauccauguucuuuguaauauauguugcuaguaugcuuuuguuucacagauaccauuggggaaacuacugaacuugagauagaggugugccauucaaauaggguugguuucuguauuaguuaacuugggcuaccaugacaaaguaccacagacaggguggcuuaaauaacaguauuuaucacaguucuggaggcucgaaguccaagaacaagguacugggaaguuuggugucuucuaaagcccgucuccuuggcuugcugaugucugucuuuuccucugugcaugugcauuccuggugucucuuuucugucuaaauuucaucuucuuuuaaggacacaagucauauuggauugugguucacccuaaaagucucauuucacuaaaccacuucuucaaaggcucuaacuccuaacacagucacauucugagguaccggaguuugagacuccaacauauggauuuggggaggauacaauucagccucuaacaguugucucuggcaauacuuaugacuacuaaaaucauaagcaaagaagguuaaauugauauuuuuuuguuguugaugaaacuguugugguuauuuuauaaaugauggauuuucauuauucauacccuccuccuacuggauaauaaugaguuaucuguguauguguuaagauucuaauaaaggcaauuaauuagguuuguaauuacaggcaugaugacuaacaaagugggggcagaaauaaaaugauggugacacugauuccacugcugugccuauaaugucacauuuacauucaugaucugugauaagaauuaagaugcucauuuauuucagugaggaaagugacagaaaaggauauaaaauuaggaauucauggggaauugguaaaaaaaaauuaaaguauuacaauaaguaacugaaacugacucagguuaauuuaaguauaaaagcaaugucuucaaaagauauuauaguucacagaguuaagggauagcuacaaucuagacugaaaaaugccaggagcagagaaaacuauaagagcagauagcccaguugguagacuuuuggugguuucuguaaggugcuguaaucuagaaugaaucagcucaacugcuuucaggcucuuugucuuucuuucuuuuucuuuuuuuuuuuuuuucuuuuuuuuccugacauucauguuuaacaccaaaauuccaggaaguaaacaucugguuggucaaguuugggucaugaaucugauccuuuuaguuaagaguaaacuuaacuaacaguuccuugacugacauuuccaccaaacuauccccauauaggaaaacuaauucaacccaaacaaaauuggagagauuaauagucuacauaggccagauacaguggcucaaaccuguaauuccagcacuuuggaaggccaaggugggcagaucaccugaggucaggaguuugggaccagccuggccaacauggugaaaccccgucucuacuaaaaauacaaaaaaauuagccaggcaugguggugugcaccugcagucccagcuacucaggaggcugagccaggagagucacuugaacccgggagguggagguugcagcaagccgagaucaugccacugcacuccggccuggcgucuggaugacagagcaagacucugucucaaaaaaaaaaaaaaaaaaaaaaaaaaaagagaaaagaaaaaagaaaacagucuacauacacaaugcuggaagguugaaagaauggcuaaauaaaucauagucuaggcaaaugaugaaauauuauaguaccauuaaacauaauguuucaaugaauauuuaauucuauauaaaauugcccagguuauaauaguauauuaaaaaguaccuuacaaacauauauaucuaggauggccccaauuacggaaaaaaaacaaacauguuuuuccuuagaaaaagcccugaagauaauauaauaguuaucucugguuuauagaauuaggauuucuguuuucuucuuuauaaaguuuuuguuuuaaaaauagaauauuacaucuuauuuuuucuuauaauaaaaguaauacauaaaggaaaaggaacauaaaguacauaaaaaaggaacauaaagugcauaaaacaaaaaaaaaauuuaaauagaauauuacaucuuauuuuucuuaugacaaaaguaauacauaaagcaaaaguaauacauaaagcaaaagggaaauauaaauuaauaaaaugaugaaauaacucacaauuuuacacaacaaaauuauuauuguuaauaauuuauuuuuucaaaugcuuugguauuguuucuuaccaaacaauuuggcauuguuuugguauguuuucuuaaaauaaaguucaaaauaaacauauguugccuuaaaaacuagaauaaaaguguacauuaguuuucaaauagaauuuaguaaucuauuucaugcaaagauacucauuguaucuuuaaucaaaauaguaaauuuaguuuaaauuauugaugaaacaauugaauguuugaauauuuugucuuuuggaauauuaauaaaacuaggccacaaaccuuguauaauaaaaguacaguauuuugaaaauuuuguaacaauggaaaagcuuugggaaucggucuaauauaaaauuagacuugaaauagcaaauuggugguguucugaaaaucauguuacuugguaaccuaaguuuucucuuuagaacucagcacgaauuuuaagaaauuuaucuuauauuuauaaaacaucuacuauuugcaaugaguuguuuuuagcaaaacuugaccucaaauugaacauuugagaauacugaagaauaaauaagaagcaccuguaaauacugacauaguauguccuuaaauuuuuaaacuacuuagaaccaaauucaucaaguuggcaaaaugaaguuacuagauuaucaaauggaauggcaagugaaaaugagccagagguggcagaauggaguaagaaggguaauuauuagggaaugcugcauuuggagaugugaaauuauauguguugaggaugugaggaaagaaaucugugugaggagaaauagauuauuaaugauguaacuuaguaacaucagauuaaggguccccaaacccugggccacggaccaguacuggucccuggccuguuaggaacugggucgcacaguaggaggugagcagugggccagggagcauuacagccugagcuccgccuccugucagaucaguggcggcauuagauucucauaggagcacaaacccuauugugaacugugcaugcacaggaucuagguugugugcuccuuaugagauucuaaugccagcccccacuccccacaauguccguggaacaacugucuuccacaaaaccagucccuggugccaaaaagguuggggacuccuuaucuagauuauuguaaagcaaauauucauaauuuuaagauuaaagaaaaaauccaauaaagaugagaaaccggaucucagaguuuccaauuacauauucauagaggaaagaaagcuaagagaauucugucacauacauauuucaaucuaagaaauucaguggauuugaaaauccuggaaagaguuacuuugagacuucacaaaugcuaccaggcagcaguuuugauauuacccuggaaugugauaugccacuuaaaaaggccaguaguauuuugggcuauguaugucaguguguugggacaaaaccaaggagaaaacaguccggugucaggucuagaauaccaucauuucagugccaccugggccucagcauuucagguuucaggugauuugaggagucugugaggucgcacaauaauauuuaaggccuuuaaagggucaaucaacuuguacaaaugaaggcaagagugccuuuggaagacauuccaaaaaggaaguuugagcauacucaagaagaaucuagccacugcacuccagccugcgcaagagagugagacgcuuucucaaaaaaaaaaaaaaaaaaaaaaaaaaaagaaacuaaauagaaaucaguaagcaaagaaaaagaaaauaggagugugauuuuucuuccugaaaucucuguggaauagcaaaaaguggaaucuugacuguaucuucucugggaccaaacuuuaucuuacucucccugacucucucucucucucucucuuuuuuuuuucauuccuaggcauuuuguuuuacucuguuuuugcauacucugcugauuucuaacccuccuuccauucaguaacauauaaaaaaaacuuuucacagucauguucucagaauguucauagucuuuaaugcauauagaauauaauccaaaaaaucaaaaaaaaaauuuuuuuuuuugagacagagucucacucuauugcccaggcuggagugcaauggcaggaucucggcucacugcaaucuccgccuccuggguucaagcgauucuccugccucagccuccugaguagcugggauuacaggcgcacacuaccacacccagcuaauuuuucuauguuggccaggcugaacuccugaucucgugauccgccugccuuggccucccaaagugcugggauuacaggcaugaaccuccgugcccggccaaaaaauucuuaaugugauuuuagcaguuauuuucaaaaugugguccacagaugcucuugcauucccuugagacuuuuuaaaugauucaucagguccaaacuauuuucauaaugauacaaaaacauuauuuaccuuuuucacuguguugacauuuggaagaacaaugaaaccccuagccuuaacacuuaucaagacagugacaacaaacuauacugucauuguauucuucacuguaauucauucccaguaaaaauaaguaaauaaauaaaugaauaaaauuaaagccaguugcacuaaaagaaugucuuugacgaaacacuagaaauuaauuuuauuuaaucuauaccauuaaguacacauauuuuuaauauucaguauacaugaagaaauggaaaguauacaugauuaacaucugcuguauaucaacaauaaugcugguugucuuaagguaaagcacuuguguaguuguuugaguugcaagcuaaacuagcuguacuuccauagaauacuauuuuuauuugaaaaaaugacugagagacaaauugugauuauucaaacagauauugaaaagacaaauuuuugaaaauaaauggagacugucauuuuaaaaauacauuugacaauauuuguugucagugacaaaauuuggccuuucaagagaaaauuauuauuuugaaaaagaugcaucugccaccaugagcucaacagcuucucaaaacuuacaggguuucugaugugauuagugguaauauuaacagaugaauaaugaaaucuuccaauauuuugaagaccugcauaacuuagccaagcacucaucccauuagaucuuuuucuuuuagaaauaugguuauuuucacuugaaauuuauuuuguugacaugugauuuaugauuauaauuuauaaauuuauuaauugaugugcuugugauuuuucugcuuucuaacaugguaaauggcaauacauugaacucauuauaaagaagaauuuuuuguuuccucaauaauauuaacaaucaaaaggagucuugagacaaaaaaauuaugacaaggaugaauuugauaauucaucagauucugggacacugaaucugaugaauuugauaauucaucagauucugggacacugaaucugaugaauuaucagauuaucugauaaauuauucagauuaaguuuguugcacuguauuaguugagauuauuauaaugcagauaauugagucccccagaauuaugcaggauagagaagauauuugucacauuacacaaguuaguacauuuuucauuacuguaauaugagcugcacauaucaguuuaguucaguaaguucuguauaaagugaguaaaaauuguugcaaagcaaaucagaggauuauaaaauauaaauguucuaauacucuuguuaggacuuucaucuuuccucaccuaaaccaauguaagaaguuucuauuggucuuuuucuaaauguucacccacucccuucccucaauuagaaccugaucuccauacuaccaccagugaccuuucaaacaugugggccacaucucuacuuuuuaagacuguaaguuauauccuggaguaaaagcuauucaguuauucagcauggcuggcuuucaugagcuguccagguuuauuucuuaccccauggucgaucuaccuuaccauuaguccuucagaaagaacuaauugcauuucugugaagaccuaaagcuguuucuaucucuaggucuuugcuacugcuucuuuauuuggugaauagccacgaccucuucuuccccaaguaugauuaauuuccuuuuguguugugccuagguccuguauacauuucuaucaucucucccacugcacuuuauugugcuuauuccccugucuuccucugcuauacuguaccuucuuugcaauauggugcagcauauugucugaugugacuaagucucauugccacugccuacuuccguuuucggugucuagguucucaauagaaauuguuaaaugaaaaugaaacaaaacaaaaacauuuuuaggguuaccuuuaauauuaauaccugacaguuuuacauuuuauaggaugcuuucgcaaauacuguuuuuguagaaauaugcuugaagcauauaauaauuuaaauaauucuuuuauuucuuaugcaagucccaaacuccuauucuaaacucauauauacuaugaguauugaacuacuuauauauacuaugauuaagcacugcuuuucaaaguaauucugaaugcauuuuuucuucaaauuauuacuguuagcuguuuuuacuuauucagugucugagaaauuugauuacuucuccuuuuaucauuuugagguauucuuuuuuguuuguuuguuuuagacggaguuucgcucuuguuucccaggcugcuggagugcaaugaagcaaucucggcucacugcaaccuccacuuccuggguucaagcaauucuccugucucagccccccaaguggcggggacuacaagcaugcgccaccaugcccagcuaauuuuuuguauuuuuaguagagaugggguuucaucauguugaccaggcuggucuugaacuccugaccucaggugauccaccuguuucgaccuuccaaaguuacaggcgugagcuaccgugccuagcucauuuugaggcauucuuuggucuuugcuugagucuaauuauuagcaaauuauucaaguacuauauuuuauaguuauggaaugcauugauauuauagaaaacagaauauuuagaaaagcauaaagaagaaaauaauauuugugaucucauaaucuaugugauuuuccccacaauaauaaaauauugcuuuuaacauguuaauauuuugcucuaaaccauuucucuuccuguuugaauaaugggauuccuaugguguuuucaauuuuguagcacauauuacaucuuaaacauuuuuuaaugccaucagaauaguucaaaaguauaauauuaauggcuucauaauauuuccuuguaguuuuacauuuauuuaauuauucugauaaucauggaaauuuuauuucauuuuaguugcaucauuacuuuugaaguaaauuuaaauaacacauuaaaaauaccaagaauuuuacauuuuuauuaauagccaaaagaucaucuguuguauaaacagaucccaaaacuuaggguuuucuugauuaaggaaaacagaaggccaacaaaguccaugcaguacacacaagauauagucaauuaacacuuaaaucugaaggaaacaauuccagugcaugguuucuugcacugggcuuguucucuuucuuuuugauucucccuucugguccucacugggaguaggaaucacacaaagagcuuggcucacuacuuucauucacucucuccuucucucaucauuuguucaaaaugaacccauuugggcuaguucuuuaauacucucagauguuuuccugcuuucagaaacaggcacaaaauaauuuauauauuaacauugaacaacucucugaaaaucauugcauuguuuaacuaauuucugauuuuucuaccacuuuacagcagaaaacaacuuucuucuuagaguucuugauacaaacuuuuuaagaaauuuaaaauauacauuaaaaucugucuuugaugagcauacuaaauaauaugauagcuggaagggagguaaggaagugguaacaguuuuaaaguucuuauuuauuuuucaaauaugaauaguuacagguuuguuauuaucuaagaaagagaauuauuaauauucuccaugagauccaaggaucacauuauaucucaaaccaagguaacauuagagugugaaaaacaauuuuaauuauuauuuuaucaauuuuaaaaauuuuuguauauuugugggguacaagugcaauuuugcuacauugauauauugcauuuuggugaaguuacggccuucagugcauccaucacuggagcaaugugcauuguauccaccaagcaaccuccuaucauccacccaccuugcaccuacuacccuuccaagucuccauuguguuuuaucuuaaaguguaguaauucuugcccucuagcaauaaccuugguguaugcaucuaauucucagaggguaaucuacaauuucaaaacuuuaaaaguagcuguuuaaaauuauagcacaccuguuauuuuauauuuaugauuaguauauauaucgguuguucaagcuaaaagacaaaugacaggaaacauuuuaaucaauagcauucuuuuagcuauuaugguaauauucauauuuauugggacuuagaguaaaacagucaggaaguuggucagagcaagaaauaauuuucucauucuuuuuucauuuacuagucauucauuuaacaauauguauugagaaccuaguauauuuaauacuaggugccaagauaucuacucuuaaguacuuagauucuaaauuuaaaaaaaagccaaguacuacuguuuuaaccacaccacuucugacaucaaauaugugggucguuuuguuuuuguuuuuguuucuguuuuucccucaccacucaauugucugacagccaguugagugucccacaauucaauucaauaauaacuuggcauuauccucagauaccacaagucaauggcucagucucacaaaacugccccacuucaaacaucaguugcaagacccaggccucuggaacuucugacugaccagcuauaaauccuccaguucaauaaugugcuacaacagcucacagaauuuaagagcuuacuauuuccaguuuauuguaaaggaacagccuggaagagacauauagcagaaaguauaggguaggagaagcuauccaaacuccauaauuuagaguuuuuauggaggucucauuauguaggcauaauugauuaaaucauugaccauuggugauuagcuuaaucuucaaccccuagcccaucccuugcagaugcaggucuuucuagugacuagccucaauccugaagcuauguaggggcccucagccacuugucaucucauuagcauacaaaaaggcacuccagagauucuaaagauuauagaagcucuuaugucagaaaauggaacuaaggccaaauauaagaaagaugcugcuaucaccaauauuaaucaggaaauaacaaggguuauaggagcucugugccaggcagcaagaacuaagaccaaauacaggcacaccucagagauauuacacauuugguuccagcccaccacaaaaaagccaauauugcaauaaagugagucacacaaguguuuugauuucccagugcauauaaaaguuauguuuacaccauacuauagucuauuagguaugugauaguauuauguugaaaaaaagugcauaccuuaauuuaaaaaugcuuuauugcuaaaaaaugcuaacagucaucugagccuucagugagucauauaaucuuuuugcugguggagagucucgcuuugauguugauggaugcugacugaucagggugguaguugcugaagguugagaugacugugacaauuucuuacaauaaaacaacaaugaaguuugccacguugauugaucuuccuuucacaaaagauuccucuguagcaugugaugcuguuugauagcauuuuacccacaguauaacuuguuucaaaauuggagucaaugcuuucaagcccugccacugcuuuaucaaauaaauuuauguaauaucuaaauccuuuuuugucauuucaacaauguccucagcaucuucaccaggaguagguucuauuucaagaaaucacuuucuuugcucgucuauaagaagcaacuccuccucucuuaagguuuuaucaugacauugcagcaauucagucacaucuucaggcugcauucuaauucuaguucucuugcuauuucugccacauuuacaguuacuucuuccacugaaucuuguaccccucaaagucauccaugaaaguuggaaucgauuucuuccaaacuccuguucauauggauauuuuuaccuccucccaugaauuacaaauguucuuaaugggaucuaggauggugaauuuuauccagaugauuuucaauuuacuuugcucagauccaucagaggaaucacucucuauagcagcuauagucuuauaaaauguaugucuuaaauaauaagacuugaaaauaaaaauuauuccucaauccaugagcugcagagugcguguugugcuaucaggcaugaaaauaacauuaaucuccuuguacaucuccaucagagcucuuugcaacauugucagucagcgguaauauuuugaauggaaucuuuuuuuuuuuucugagcaguaggucucaauagcaggcuuaaaacauucaauaaagcaugcuguaaacagaugugcugccauucaggcuuugcuguucuacuuauagagcacaggcagaguauauuuagcauacuucuuaagggcccuaggauuuuuuugacuaguaaaugaaaauuggcuucaacuuaaagucacuggugacauuagcuccuaacaagagacugaaccuauucugugaagcuuuaaagccaagcauugacuucuccucucuagcuaugaaaguccuagauggcaucuucuuuuaauauaaggcuguuucaucuauauugaaaaucuguuguuuaguguagucaccuucaucaaugauuguauuagucuguucucacccuacuaauaaagacauacccgagacuggcuaauuuauaaaggaaagcaguuuaacggacucacaguuccacauggcuagggaggccucaaacaaucaugguggaagaugaaggaggagcaaagggauguuuuacaugguggcaggcaaagaaaguuuguguagagcaacuccccuuuauaaaaccaucagaucuccugagacuuauucacuaccacaagaucagcaugagaaggaccugcccccaugauucaauuaccucccacuggguuccucccaugacaugugggaauuaugggagcuacaauucaagaugagauuuggguggggacauagccaaaccauaucaaugaucuuagcuagaucuucuggauaacuugcugcagcuucuacaccaguaccuacugcuuaaccuugcacuuuaauuuuauggaggcagcuucuuuccuuaaaccucauaaaccaaacucugcuaacuucaaacuuuucuucuguagcuuucuuaccucucucagccuucacagaguucaagagaguuagagccuugcucugaauuaggcuuuggcucaagggaauguuauggcugguucaaucuuuuguucagacuuucuucauaucagcaauaaagccauuuuacuuucuuaucauuuuuguguucacuggaguagcacuuuuaauuuccuucaagaauauuuaagaauauuucuuuuucauucacaacucggcuaacuguuugguucaugaggccuagcauuuggccuaucuagguuucaacaugucuuccucacaaagcuuaauuauuucuagcuuuuaauuuaaagugagaaacauucaauucuuccuuugacuugaacacuuaaaggccauuguagggauuaaaaaaaaauuuuuuuuauuuguauggcuacauaguagguguauaccuuuauggguuacaugagauguuuugauacaggcguaucauaugcaauaaucacaugagaguaaaugggguauguguccccucaagcauuuaucauuacuuuguguuacaaacauuccaauuauacucuuuuagcuauuuuucaauauagaauaaauuauuguugacugugauaacuguuguguuacuagaucuuauucuauuuaacuacauuucuggaucuuauucuaucuaacuacauuuuuauacccauuaaucauucccaccuccccaccacccacauaguaggguuauugauuggaauaauuucaauauucuugugucucaaggaacugggaagcccaaggagaggaagagagacgggaacagcauguugguggagcagucagagcagacguaacaccaauuaaguucacucuuauuugggugcaguucuugccauccccaagcaauuacuaaagugacauuaaauauuacugaucacaggucaccauaacagauauaauaauagugaaaaaguuugaaauauugcaagaauuaccaaaaugugacacagauacacgaagugagcacaugcuguuggaaaaauggcaccaaaauugacuugcuggauguaggguugccacaaacuuucaauuugugaaaaacuguaucugugaagcacaauaaagcaaaguacaauaugucaagguauguauguauauacuucuuaugauaagaccacaccaaguauauaaaauauuuucuaaagauggcacuuguuacuucuuugagacucucaauguguugcauacuauguuuaagcuucaaauuacugaucuuaaggaaaucaauguucuuaucuaucuguacuguuaucuugauguaaauucaguaguguaccuaguuagucagaguaggauccaaaauuccaaccuaaauuuugaaacaaagauuuuucuuuauuauaacgcccaacauaacaccaagaguaguuaauaaacauacuaagaugaacaauuauucuugacuuuaggcaaaaagaaaauuacuaaaagauguauuuauuaaucaaaugcuguaauuuuuguuauuauuucuguaaaguucuaaacuccuugaaauccuauagaagagaaaagaauaaaaaauugucaaggcauucugauucaaacagaaaaagaagggaaucaaauaauuaucacugcuuacaugauuaucauuguaguuuuagcuccuuguuaguucagugcuuuuuuguauauuuauagaguugugcagcaaucauuacaaucucauuuuagaacauuuccauugagcuaaaaagaaacuugaugcccacuuguagucacucucuauucccacucccaguccuaggcaaucacuauuugcugucucuguacauuugcuuauucuagacauuuuauaugaauagaaucaugcaaugugucaucuuuugugacuuucuucuuucacuuaacauaauaucuuugagauucacucaccuaacagcauguuucaguauucauucauuuuaauugaccaaucauacucccuuauauggauauaccacauuuuguuuauccauuuaccagcuaauggacauuugggugcuuuccacuuuugggcuauuguuaauaaggcugcuaugaacauguccauauaagucuucauauggauacauguuuucauuuaccuugauuagauaccuaggaaugaaauuacugggucauauaaugaaucuauguuuaacauuguaagacacugccaguguauuuccaaauggcuguaccauuuuacauuccuacuaacaauauaugaggguuccaguuucucuauauccuucccaacacuugugauuaucuguuuuuuuuauuauuauuauagucauuccagugugugugacgugaugucucauuggguuuuuuauuugcauuuccuucaugauuaaugauguugagcaucugaugugcucguugauuagucauuuaucuucuuuggacaaguaucuacccaaaucuucugccuauuuuuauaguuagguucuuugggguuuuuuauuauugacuuguaagaguuuuaaaauauauauauauaugccagauacaaucgcuuaucagauauaugauuugcaaauacguucuuucaaucuguggguugucuucauuuuuugauguugucuuuugaagggcaaaugauuuuuuaugaaguacaauuuaucaauguucucuuuugaccacuuaugcauuugguguugcagccaagaaauuauuaccuuauguaugugcaccauauuuacucauauuuuuaaagaauuauaguuuuaguucuuacguuuaaauuuaugauuaauuuugaauuaaucuuuguacauuguuauccacaguuucaaauccuuccuuuugcauguggauaucugguuuuucuaguacuaguugcugaaaugauuauucuuucccaauuaaauuauguuagcacccaaagcugaauugauaaaaauuguuagccaaguuguguucucuucuuauuuauucaagaaugguucagaauaagaacuauugcuacuuuacaugugucagauaucuaaauauuaagaaaaguaugugaucacuauaaaauucauacuuuccaguaaauuacauuuaccauacaauguucaauacuguaacauauucuguauuuuaacuuuugauuuuuuuuuauaacuguugaauuuugaacuaucguguuuuguaaccucucacucuuagguguuguuauuccaaauauuuuauuaauuaauucagcaacuauugugugacuguuauggguaaaguacuuugcacgauacagugaagaaugcaaagguaaaugcugcucucaaggugcuuauggacuaaagcaaaaaacaagacauauucacaagcaaauauacugggagguagaagucagucgucaaguaacaccagaguugcagauaaaugcuuaugugaauucgaagauuacuugcuuuuuguuucagaaaagugcuaguggaugaagagaucaacagccuauaugacagcaaauuugguuccauguuggucuauacaaguaguuaagggcaaagaauaagcaguaaguuucugaugaauauaaauaaaauguauguagcuguuaagaaguauagucugugauuuuaaaaaaacaugaauaaugauauucauguacaagacaugacaguuaccaguguauugccucuuagcucucuuugguagcuaaccagaaauaguguauugggcacuuaaagcauuuuucuuagaccgugagcauaacguuacucuuugucaguagagggcagugaagggucacugcaggaggaaggggcuucucuuccugguucuaaugcuacauuuugauuuuacuucgaucauuagcaauguggaccauuagcaauggaccauuggcaacgugcuuguguaaugacaucuggugguguuuuuccccagccacaugcccagauggggcagucuguuggugacuucacagccucuauauaagggccuagugaccacuuugccacaguucucccagcacugacaccgcacacugccaacacagacacauccucacuucagugccgcacuccuucugaaggcccacccaccaaccuuagcucaccugugcccuaaagaauuguuucugcuugcccaacaguagcccaacuguggaccagagcuccggccaggacaccccagcaaacuauucugcuguagagaaagagggcuuccaccacacuuuucccaaugaaguuuggaccccaaccuugggaugggaaauccuuccaguucacucuucuuugaguccucuaccuuagcuccaggauacccuuuagauucucuuacaucuuuaugguuacucuccuaucaguacuuaauaauucuucauauauuaaacuuucucuguuuaaauuagcaugugguuucuguaucuuuuuuuguuuguuuuuguuuuuguuuugagacggagucucgcucuaucgcccaggcuggagcacaguggcgcaaucugggcucacugcaagcuccgcuuuccagguucacgccauucuccugccuuagccuccugaguagcugggacuacaggcacuugccacccagcccggcucauuuuuuguauuuuuaguagagacggguuuucaccguguuagccaggauggucucgaucuccugaccucgugauccacccgccucggccucccaaagugcugggauuacaggcgugagccaccgcgcccggcccgguuucuguaucuugauugugucccagacugauaccuguugccacaaguuauuuugcucaguuaauauuacugauuuucaaaugcuucaguuuauagggguaaagacaauuucuugaugcuaucccugaaaaggaauuggacaaguuuaacuuaugucaucuucucaugggcuucauggaaaauagccuuuuucacuagugaauauuggauaugcucuagcauuuccacugagaaauaaaaauuaggcauucauucaaaaaaguguguuugauccuauuucuaauucaaaugcuuugauuauuauugaguuauucauauaguagauuuucuaaggauuaauuguuuuuggccaagauaaaccaaaugugguagauguaaacuauuuucauauggucaaauacgugaugauuauuuuaauauaaaggguuucacugaagcauaacuacaauguaaaggguuucacugaagcauaacuacauauguagaaguuuuaauguguaugaggucuguaauucauaaaauuguugguugauucuuucuguuucacuucuauuggcaaagguuuaauuuacauucaggccuggugguaacccuguuaauaaccaaauucauucucucauuuuaaacuuauaacuuggcaaaagggaaacccuugaugaaguuguuuuuaaacuuuuaugaaugauucuuuuuaaccuuuuuaaacucugaaaccuuuuaaaagugaaaauauucaucacuuucuaaagaguauccacuuuguaagguccagguacagcaagcaaauauguauaaaacauuaaauuaagaaaacuucacacuuuuuccucuauagcaaaaauccuaaggaguaagacauaugauauaagcuauuuccccuaggacuucacugagguuauuugaaacauaucagaagcugagaaauuacgucauuucuuuugcuauuuuuauuccuugaggaaauaacuuuuuucaggaccaugauaccaauucuuuucuucuuuacaagcauuccugugcuuucuuacaacagcauacuggcaacacaaaguagccaaaucggcucuaagacaaaugucugugaaggcuguuggcugagaaauaucauuuggcggucucauagucucauauauaaaauguaccuuaauuuuuuuauuuuuuugagacaagaucuggcucugucacgcagguuggagugcaguggugccaccuuggcucaugcagccuccacuucccaggcucaagcaauccccccaccucagccuuccaaguagcuggaacuacacaaacgcaccaccaugccugguuaauuuuuguauuuuuuguagagacgggguuuugccauguugcccaggcuggugucgagcuugugagcucaagcaauacaccugccucagccuuccaaagugaugggauuacagaugugagccaccaugcccagccccauuuacuuuuuaaaccaccacaaucauuauuauaucguagcacucuagguucacagaggugauuagggacaacuauguugguaagucaaugaacucucuucuguucuuaccuuacuagauuaugcuguaacauuagacaauguucaucauuaucucuuucuuacucucucuucccuguuacuucuucuagaaaaugggucuuuguuuguauucugcaaagauuaaaguugaauucuaacaaugaaagcauucauuuugacuaaacucuaguuccauaauuuuucuuagaaaguauuggcaaaucuguuuaugucucuuuucaauuauuuuuccuacuaucucuauauaccaccaauaaaauuaacuaacuaaauuuaguuuuauuucaaaucacucagugguucuuuuauucaaaagauauuaauaagcauagugucaggcacuaugccaugaacagagauacauuuccaggaaauugauauaauggaaagaaacuagggcuagagucagacaaaucagcucuagcuauacacugcucuagcuauacacaguaucacuuuaauuagcuacauuuuuucugacuuuuauugcuucaucuguaaaauagugauaauaauauauauuuucacguuguaugguaaagucuaaaguuauguucaccaauacauaaugcaguucuuggcacuggguagaugcuuuuaaacacuauuaguguucuuuaugguauuuuuucuaagugacuaaaagaucauauuaauuuuacaugccucacauguccucaguccuuuaccuuuaucuuccuggugaauuuccuuuuauuuuacaaaacccauuucagcucucaccuacuuaggaagcuucucuuaacauuuuucccccuccucauaucccaaaagaagugauuauauccucuucugugcuuccuccgugucucaaagauaacuuauuguuauacuuccucaguauuuauuuauuuauuuauuuauuuauuuauuuauuuauuuauuuaagacagagucuugcuuugucacccaggcuggagugcagcggugcgaacucggcucacugcaaccuccaccucccggguucaagugauucuccugccucagucucccgaguagcugggaccacaggugccugccaccaugcccggcuaaauuuuguguuuucaguaaagaccagguuuugccauguuggccagacuggucuugagcuccuggccucaggugauccgcccuccuuggcuucccaaagugcugggauuacaggcgugagccaccgcgcccagccuacuuccucaauauuauaauauauugcuauucaacugugucuggccuaacagacugucugcuccucuagaacagaaaccgucauauauauauauauauaucucccaaaucuaaagucaggcuugaaaucuaauaggcagcucaaaaacaauuuauucuuaaacagaauugaacaaugccuuaagguacaaaaguugugcauuauccacaaaauagcucgaauauuacugaaacuuuguugaaugguauuuucucugaagcacccauguugcuucaaaggacaugcuuuuguucuuauuuauggcuguguaauguucccuagcauauauguaccacauuuucuuuauccagucagccauuaauggacaucuagguugauugcaugccauugcuauugugaauagugcugcaaugaacauaugcgugcaugugucuuuuugguagaaugauuuauaguccuuuggauauauacccaguauugggauugcugggucaaaugguaguucuguuuucauuuauucugagaaaucuucaaacugccuuccacaguggcugaacuaauauccauucucaccaccaguguauaaguguucccuuuuccccacaaccuugccaacaucuguuauuuucugacuuuuuuuuuuucuuuuuuuucuuuuuuuuuuuuuugagauguaaucuuacucugucgcccaggcuggaauggagugcuguggagcgaucucggcucacuccaagcuccgccuccuggguucacgccauucuccugccucagccuccugaguagcugggacuacaggcgcccaccaccacacccggcuaauuuuuuguauuuuuaguagaaaugggguuucaccguguuagucaggauggucucgauauccugaccucgugauccgcccgccucaaccucccaaagugcugggauugcaggcgcgagucaccgcgccccgcccaugacuuuuuaaaaauugucauucugacuggugugagaugguaucucauugugguuuugauuuucauuucucuaaugauucaugauguugagcauuuuuucauaugcuuguuggucacguguauguauucuuuugagaacugucuuuuuaauucuuugcccauuuuuaaaugggguuguuuuucacuuguugauuuauguaaguuccuuauagauacuggauauuagaccuucaucauaugcaugguuugcaaauauuuucucccauucugcugguugucuguuuacucuauugauaguuuuguuuuuguugugcagaugcucuuuauuuuaauuaggucccacuugucuauuuuugguuuuguugcaauugcuuuuggagacuuugucaugaaaucuuugccaaggccuuaaucgagguauuucuuaguuuucuucuaggguuuagaguuuuaggucuuacauuuaagucuuuaauccaucuugaacugauuuuuguauauggugaaaggaagggguccaguuucaaucuucugcguaugguuagccaguuaucccagcacaguuuauuuaacagggagucuuuucugccuugcuugcuauuaucgauuguguucaagaucagaacgucguaugugugugacuuuauuucuggguucucucuucuguuucauuggucuaugugucuguuuuuuuuuuuuuuuaauuauacuuuaaguuuuaggguacaugugcacauugugcagguuaguuacauauguauacaugugccaugcuggugcgcugcacccacuaacucgucauccagcauuagguauaucucccaaugcuaucccuccccccuccccccaccccaccacaguccccagagugugauauuccccuuccuguguccaugugaucucauuguucaauucccaccuaugagugagaauaugcgguguuugguuuuuuguucuugcgauaguuuacagagaaugaugauuuccaauugcauccaugucccuacaaaggacaugaacucaucauuuuuuauggcugcauaguauuccauaguguauaugugccacauuuucuuaauccagucuaucauuguuggacauuuggguugguuccaagucuuugcuauugugaauaaugccgcaauaaacauacgugugcaugugucuuuauagcagcaugauuuauaguccuuuggguauauacccaguaaugggauggcugggucaaaugguauuucuaguucuagaucccugaggaaucgccacacugacuuccacaaugguugaacuaguuuacagucccaccaacaguguaaaaguguuccuauuucuccacauccucuccagcaccuguuguuuccugacuuuuuaaugauugccauucuaacuggugugagaugguaucucauugugguuuugauuugcauuucucugauggccagugaugaugagcauuuuuucauguguuuuuuggcugcauaaaugucuucuuuugagaagugucuguucauguccuuugcccacuuuuugaugggguuguuuuuuucuuguaaauuuguuugaguucauuguagauucuggauauuagcccuuugucagaugaguagguugugaaaauuuucucccauuuuguagguugccuguucacucugaugguaguucuuuugcugugcagaagcucuuuaguuuaauuagaucccauuugucaauuuugucuuuuguugccauugcuuuugguguuuuggacaugagguccuugcccaugccuauguccugaaugguaaugccuagguuuucuucuaggguuuuuaugguuuuaggucuaacguuuaaaucuuuaauccaucuugaauugauuuuuguauaagguguaaggaagggauccaguuucagcuuucuacauauggcuagccaguuuucccagcaccauuuauuaaauagggaauccuuuccccauugcuuguuuuucucagguuugucaaagaucagaugguuguagauauguggcguuauuucugagggcucuguucuguuccauugaucuauaucucuguuuugguaccaguaccaugcuguuuggguuacuguagccuuguaguauaguuugaagucagguagugugaugccuccagcuuuguucuuuuggcuuaggauugccuuggcgaugcgggcucuuuuuugguuccauaugaacuuuaaaguaguuuuuuccaauucugugaagaaaggcauugguagcuugauggggauggcauugaaucuguaaauuaccuugggcaguauggccauuuucacgauauugauucuucccacccaugagcauggaauguucuuccauuuguuuguauccucuuuuauuuccuugagcagugguuuguaguucuccuugaagagguccuucacaucccuuguaaguuggauuccuagguauuuuauucucuuugaagcaauugugaaugggaguucacucaugauuuggcucucuguuugucuguuguugguguauaagaaugcuugugauuuuuguacauugauuuuguauccugagacuuugcugaaguugcuuaucagcuuaaggagauuuugggcugagacaaugggguuuucuagauauacaaucaugucgucugcaaacagggacaauuugacuuccucuuuuccuaauugaauacccuuuauuuccuucuccugccuaauugcccuggccagaacuuccaacacuauguugaauaggaguggugagagagggcaucccugccuugugcccguuuucaaagggaaugcuuccaguuuuugcccauucaguaugauauuggcuguggguuugucauagauagcucuuauuauuuugagauacgucccaucaauaccuaauuuauugagaguuuuuagcaugaaggguuguugaauuuugucaaaggcuuuuucugcaucuauugagauaaucaugugguuuuugucuuuggcucuguuuauaugcuggauuacauuuauugauuugcguauauugaaccagccuugcaucccagggaugaagcccacuugauugugguggauaagcuguuuuugugccaguacuaugcuguuuugguuacuguagacuuguauuauaguuggguggugugaugccucagacauuguucuuuuuguuuaggauugcuuuggcuagucaggaucuuuuuggguuuuauaugaauuuucaaauaguuuuucuaauucugugaaaaaugacauugguaguuugauagaaauagcauugaaucuguaaauugcuuuggguggcauagucauuuuaacaauauuaauucuuccuacccaugagcauggaauguuuuucuauuugugugugccaucucugauuucuuucaucaguguuucauaauucuuguuguagagaucuuucaucucccugguuagcuguguuacuagguauuuuauacuuuucguggcuaucgugaaugagauugcauuauugacuuggcucucagcuuggauguuauugguguauggaaaugcuacugauuuuuguacauuaauuuuucauccugaaacuuuccugaaguuguuuauuugaucuaggagccuuugggaagagacugugggguuuuguuuucuagguauaaaaucauaucauuuucaaagagagauaguuugacuuccucucuucguauuuggaugccuuuuauuucuuucuccugccugguugcucuggcuaggacuuccagcauuauguugaguaggagugguaagagugagcacccuuguuucguuucaguucuuagggagaaugcuuucaucuuuugccuccucaguaugauguuggcugugaguugguuauagauggcucuuaugcuuuggccuaauuuguugaggguuuuuaacaugaagagauguugaauuuuauugaaagccuuuuccgcaucuuaauuaagaugaucaugugguuuuuuguuuuuaguucuguuuaugugaugaaucacaucuauugauauguauauguugaaccaaccuugcauccuaggaauaaagccuacuugaucaugguggauuagcuuuuuggaugugcugcuggguucaauuugcuaguauuuuguugaggauuuuugugucuauauucaucagggauguuagcuuaaaguuuucuuuuuucauugugucucugccagauuuugauagacagauagauauuucuugugaauuguuacaaaugcaagagaagaaaacuucauccaaacaaggcagauugcauacaaauauuucuacaaugaccucuauuuaucuagauaaaaguuuucuaauucuacaagacucuagaauacaacuucaaauagaggcuaggugugauagcucaugccuguaaucccagaaauuugggagaccaagguggaaggauugcuugaagcuaguaguucaagauccaccuaggcagcaaagugagacccugucccuacaaaauauuuuuaaaaauuagcuggucaggugauacacaucuguacuccaagcuacugaggaggcugaggaagggaucacuugagcccaguaguucaaggcugcagugagcuaugaucaugccacugcacgccagccugggugacagggcaagacccuauuuuuuuuuaauugaauacaaguaccuuugaacauaccaaauauaauuuuauaucucuuauuucaaagugaagucuagauaaucucacguauaagcauuuuuuuaaacauauagcagaucucuagagaugguguuuaucugauuuucaaacccuggcauuuagaaaaaacaaauuaauaaagacuaaaggaugagguaggcauugagauuucuagaacuauuaauagguuuccccuucuaggaaggaaggugaaaaaaguuucaaaaauagaaacgaaguguaaucacuguacauuuguaaauuguuaaaaaagaaaacauuggaaggccaaggcgggcagauugcuugagcucacgaguucaagaccagccugggugacaugguggaacccugugucuacuaaaauacaaaaaauuagccaggugugguggcaugcaccuguagucccagcuacuugggaggcuaagccaggagaauugcuugaaccugggagaguuagguugcagugagccgcgaucaugccacugcacuacagcccgggcaacagagccugaccccgucuccaaaaacacaaaaacaaaaacaaaaaaaacacacacaaagaagaaagaaguauauaguauuuuagauuuacaucacuaauggugaacacuuagaguguuuuguuaagucuagugguaaacuuuaugaaagggcaaauuuggaggucuagauuucagaaaagugauugaagaacuuuaggacuuucaucuuaacucaguaucuucaaauuucaauaaaaacaaaacaaaaacaacaaaaagucacacauauauuaaaauuaauagucaccuagaauagcauagaauaaaauuacuaugaccuugugaaaagaaauugucagaucaauguaauuuucuuuugaguugaagcaaaaugucauguugaucaagaaaaaaauaauggauaccacuuaucugugcuuuaagaagguauuugcauaucuauacauguauauguucuuauaaaaaacaugaucucucaggcugggcgcaguggcucacgccuguaaucccagcacuuugggaggccgagguggguggaucacgaggucaggaguucaagaccagccuggccaacauggugaaacccugucucuacuaaaaauacaaaaauuagcugggugugguggugggugccuguaaucccagcuacucgggaagcugaagcagagaauuguuugaaccagggaggcggagcuugcagugagccgaauucacaccacugcacuccagccugggcgacagagcgagacucuguaacaacaaccaaaaaaaaaagugauuuuucaucccugauuuccaacuuucauaucagaauuauggacuaccauaugaaugaaagaaauugaacuuucagugucaguugauaguaacaauagacauugacucucaaaagucuucuguggagucaauaacucuuugagagaauuugcauuuuauuaaauacuuacauuuguauaauuuaaaaagaauauagugugaauguuuguaagacauguauuuaacaugaauccaaaacuggagugggacauuaugaauucuugaaaacuuuagaauaaaucugggccuaauuuucugcaauuauucaucuguaucauauugcuuuuaggggaggguucaagugguucaagguaaguaaugaugauuuuaugacauccuggaaaaauauauuaauuaccauuuaucuaaauuaaucuaaagacuauuaccauuuaauaguuuuucaugcuggguauugacauuaaauauaaauuuuaagugaaacugauauuaauagcucugaggaauguauaaauaggaaacagaauaaccuugaaaccuuuaggaauuggcccaucaaggcaagugagacucuagugucaaguuugguuagcguguaguauauuuugaaccaagaacaaacuauacaaauaacaggauggcagagaagcuaauuagucacaaauuugguagaaccaauaaggcucuuuuauuuaacaggcaucguuguuucugauugauagcaggaagaacaggagaaucaugggaucaugggauauuuuuauauuuaaagaucaguuuuauuguuucaaucccccuuuguuaaaaugucaaacuggcuuguacaaugacaaaggcuaaauaaagguauuauauuacuaaaaaacuugacacaguaauucguacuaagggaaauguauacaaaaaucagacaucaucuuuuuacuguucuuaucaccauuauucuauuacaguuucuacccuaaggagauuagugaaguugggcagaaauuagaagggagcaaaagaggaauacaaauaauuauaucauaccuauggguuaaaauauugaaaauuuuucagcuuggaaaagagaaaacuaaagagagacauaauaacugccuucaauuguauggagguuugucacaaggaggguacguaauugaauuuuuaucccuauggaaagauaaaucauuuaaaauggguauaaacuguagcaauggggagcuuauuuguuuguuuucuauuuccaaaaauuauuugaucugacuuacaaaaucaaauacaauauaaagcagaauaauaaagaccaaaugaucuaaaaggaguggugaaauagauguugccaaauucagaaguguaacugcaauuuuuguuugauccugauuuuggcauuguguuuuuaacagcugaaggggaaggguaggagcacauggaggguuacauagauagaucccauagacuacacaggaaaggagcacacugcccaucucugauagcccuguacccucaagaguauaacugagcaucguugaaguuuaauagguccuuugguguuugguuguuugguugauugguauuuaaugaucuuuuguuguuguuaaauucuauucuacuccaugcguagcaacuaaauuauuagaagaugaaacugcuaguaagaugccaacugaauagaacuuucugguauuuuuaucauauccaacuuauuuucugcauuuggcccuacuuugaaacaucuaaaaugcuagauauuuuuauacuaagauucuuugaauuuuggagugcaacauucagaauguuauuccuuauuucugccaagagauuauauaaugacauauaaaacugugacuuuauguggaaaauaaauuugacucaauuuaauauucugggcacaacuuacuaucaacuacacuaaaacuuguucugucuggcagauauucucuggggucuaaauugaucauuuaaaaggacacuuucaaccacucaacucauuaaguggcucagugauucuguuugcaaguaguccauuccaacacgucuaucaguauacaauucucaaaauuagucguucuccaagggucauuccuuguuuucucauuuaauauuuaagguguaauaauaauggcuuucuuuuuuucuuaucagauguuuuauccauccuucauaacauagaucucugguaucccaacuugguauuuguccaaguacuugaaauaauguuaaagaucauuuuugugugugugugugugugaaagauuugaccgauaaggauucuuuuagcuauuuucaugaaaaaguggaaugacucaguuucucaaugugaaaacauauuggggucauaaguguuucuaaugaaauaucagucuugcugccugaauuucugguuuuaaaacaagagcauugaacugugaaagauuagacccggauuuaaaucucaaacuuccuccaaacugucugacaauggucaucacuuuauuaacuugugcuauuuaacuuugcugaaccuccauuuuuuucuuuuguuuuaaaacaaaaguuaagaacauguuauguucaguguuuuuacauugugcuuuugucagaacacuuguauucaaaacauaaaggcacauuuaagcggguauaaguaaaaugguuuauuuauuauaagaauucaggccaugcaugguggcucacgccuguaaucccagcacuuugggaggccgaggcggguggaucgugaggucaggagguugagaccauccuagcuaacacggugaaaccccaucucugcuaaaaauaaaaauaaaaaaauuagcugggcgugguggcaggcaacuguagucccagcuacucaggagguugaggcaggagaauggcgugaaccugggagguggagcuugcagugagcccagaucacgccacugcacuccagccugggcgacagagugagacuccaucucaaaggaaaaaaaaaaagaagaauucaacugaaaaucccauaggccaaaacccaaguaagccauaaagagauuaaacuggaaugagaaguccagaaacauaucaacacagccuacauucuuucugaaugcuugcauggcuacuguuauuucuguuuuuuuuuucugcuuuggccgauauccucugcuuggucauggccagacauagcuuccucauccucaacucuaggucaugcagugcaucuucucauaacauucugacucacucacucuuacuucauuuaaacaucacccagaaagcaaauucuauuguuucaguuaagccuauagaugagugccccgugaucagcguccucauaaaaccuaccaagcuguggccaugggaaaggggugaaagagucacaugguauaaacauaguuuauacuuucaguauggguuacauggaggacaauuucaaaaaaggagugagggcugaguuggcaccuaucauguguuauuauaaaaauuauucccauuuuauaaaugauagaauugaagcuaagcaaggccaagguacuauuuuaauaucacaguuuuguuaaggacuacaaccaaauuuugaaccugacuauucuuauucuaaguuuaaugaucuuaucacaaaacuuaccugguugagaaaauaaaucuccauguaagaaaugauuuuuuccuaccugagcaugguggcucaugccuuuaaucccagugacucccgaugcugaggcagaaggaucacuugaggccaggaguucaagacuagccuaggcaacauagcgagaccucaucuguacgaaacaauuaaaaauaaacccaaaagauaugaccuguucuaacauuuaaauuaauugaauuauggaugcaucuuuaaucaacaaaccaauaccugcaugaaucgacucagucccuuagguaccaaaagcuugcuuuuuuauauuuguaauggaugcuuuuccuagaccauucucuaaaacaguguuucucaaaauuugcccauucauuaacuaugagugcuacauccugaucaccuggacaagcaguuuaaacacagauucuagguccaccuuagaucucugaaacaaaaucuugaggugggaccuuggacuauguguuuucaaaaagaucuccacaugauuuuuaugaaugcaauggucuauauuuucaaaguguagucucuacuagauaaacagaaagcaauaugccauauuauuuaaguucuccacaaagacgccuucgcuuaauuaaaauuugguauuacauucuuggauuuuaaagaaaaaaauauuaucugaaugaagcucuaaacaguuguuuuauggcuacauguuuuaguuuccuuaguuugaugauaacacuuguguuagaaugagaugggugggaaggacagugacauuugcccuuccuauagcccgugcacugagcaggugaccuaggauaaggcauugaucaugaauucaguuauucauucauucaaaaaaaaauuacugagcacacuguggcaaacauuuugguuucuucaauauguugcauagaaugauuaugcauacaauucuaguggcguggggaaagaaacauuaagcacaagacguuuaguugauuucauuauugcacuaaaguauuugccuuuuucaaggcugaaguugacuucucugccuuccugagccauagggaaaagggucuugucuugcuuaugcagccagcaagauguaucgguuuaagaaaagugcugaguaaugccugcaaauauagcaggcagucagccucuucucugcagcuugguucauguccuuuacccaugcuauuuaaccccugauguuuuuauaucccuauuucuaaacucaaaaugaaccucaaacugaauaaggcauacaauaaauguauccauauuuucuuuauucaauucaguagcaucuaaaucccucuugugaggacccucugcuuuggucauuagauaguuaaaaagauuuaaaauugcuauaugucuaguuucuaaaaauugcuaaaugauuuucuaagguaaacaccuuuccguguauccagugcuuaacagaauuaauguuaugugaguuuucaaaaaaaagaaaggaaaaaaaggaaaucucuuuuuugucucagccgacagcaagcagugcugcuccggaaagaaaugauuuuauuucuagccucucugcagcaucucccuaccgcauuaguauguugcugcaaagcuauccauuguguaacuuuccccaucagucagucagcuguguaguucucuuuccuaugaaaucguuaugccacaggagacaaaaauaaaaauacaaugcagguuaguucauuauauccugacaucuguuucaugcagauugugaugcaauaaaauauuaguaauuuaaacagaauguaauugugguuugaaaucacuuggguaaaucguguuauuuuaaaacaaaucuuaggaaaaugaaauuuaaacuuugcacuauuugauuaggauuaacaaacaagaauaugaauaaaccaauagauauaaaauauuagacuuuaguacuuagaauauguuuuaagaguuugcuucuaguauaaguuuuaauuaacaauuauucauuagcugaaaauuuuugaggaccuauuaaguaccuaucacucuucuggguaccaugggaggugaaaaggggguuuaaaguuuguggcgaauguauaguaguuacauuuuaugagaaaaugucucauaccuagugacugguaaagacaauaaaggcuguagacccuggugacuagugaagaaccuauggccuggcuucugcuuaaagagagcucaauguugcaaaauuccuauuugcccuuucacuuuugcuagaaguguauugcaucacuuguaagauuaaagggaaaauauacuuauuuuguuucccaaaaguuuauagguuucugacuuucacaaaugcuuaagaguacucuucucuuuguuguuauggcuguccacguguagcaguuucaucuuuagaaguuuaaauucuuuucucuuucuugcuggauacaauggcucaugccugucaucccagcaauuugggaggcugaggcaagaggaucacuugaggccaggaguucaagaccaccugggcaacauagagagauacugccuguacgaaaguuuaaaaaucagcugggcaugcugguaugcaucccagcuacucaggagccugaggugugaguaucacucggggccagaaguuugaggcuacagugagccaugaucucaucacugcacuccagccugugugacagggcaauacccuauaucaaaaaaaaaaaaaaaaaaaaaaaaaaaaggaaagaaggaaggaaggaaggaagauaauuucuuugguuuguauaggaccuacggaguuaaagcgaagugauaaaauaaaggaggaguccuuaaugugcaaagaugcacuacucauauauuugaggauaaucuuacaucaauacuuuuaauaaugaaagaaaugugaaaauaugcuugccacugguuuuaacauuuaccaucauccauguuugaaaaauaaaacccaacacugguuccucucaugaguauuuaauuguucaagaaaaauccuagaaugagugaguuuuuucugucaguaccaccuuacacucucuacccccauuccaucuuuuuauauagucucuuccuggcacauugauaauucauuccaucagaaaauccccacuaaaaguaauucauccauauguauucuuccacugaaauuaacaggucccagccagccccauccccuaccuagucaaccaaaaaaagaacucuuacgcccucucucugauugauuaacccacuuugacagugagaaaugcauuuuacauugagaaguaaguagucucauugaugcauaaacgacucauguacucccagagauacuugucuuuuaaaaggaagcgcuugcuaacugaacugaaaaugcuaauuaauugaauuucaggaagcaggaaaauaauuuuuuuagcagagaagacuuucuucauauauagggcugcuacauuuggaaacuaaacauacaaacuguccaguuauauuugacuuucagauaaacaaugaauaauguuuacuagcagugggccccaaauauagacaaugagaacacauggacacagggaagggaauaucacacacuggggccuaucgaggggugggggccuaggggagggauaggagaaauacucaauguagaugacagguugaugggugcagcaaaccaccaaggcacguguauaccuauguaacaaaccugcaaguucugcacguguaucccagaacuuaaaguauaguaaauauaaaacaaauuguaugagguaugcuuaugcuuuaagaaaucaguuaucugaaauucaaauuuaacuguguggcauguauuuuuucuggcaacccuguucagauaucuuaaaucauuauggugguuacucauauccuccaugucauaaugcugaccuugggucucccuacuuccaaucugccaguccagccccuuuggacaucacuguuuccuuuacgcaacacucuaccuagagaacaacaacaguugucgcaacaaaucaaguacucuucuaggccaacuugguaacauucuaaaacaauaaugcccuaccuagcccacgggcuuugggacuuuacugggggugaauguaggguagcaggugagauauauuugggaauuuaaacaaaagaaaauauaauuugagcauaggcuuuagcugacuguaauaauaguauuuaaauuauuuauaagguuuuaacaaagcauauaauugaacaauuucagcugccaccugcuauugaggauaacaaaaaggaaaauuuucucagcacuuaagaaauguuagaaaacauauugauaugaaagaguagaaaugaauccaaaaaagcaugcauuuuuuucuuuagcaauuuuuguuuuaacuauaucuuuuuccaguucuucaucauugacaccugaaaauaggcauuggcaccacaaaaaugguuagauggagagaaugcaggacaugcauugaacuuuauauuccauugucuuacauguuuaucaacauucacuuugauguaccaaaacuaucuuuaaaugagaugcacauuuuaauguacaucuagauuagagaaaaaucacucuggucugauaacuuuaugggauugugaauacaagugaugugaugggugguugaccaauuauuuuaaaaaugguuuagugacaauucaagauuguguuguagcucauacccuuacacacacacacacacacacacacacacaaacacacagauugugggauugacagagauguucaguuuucaaagucaauguuucaguguucaaccuccauuuucuucuacucugggacuuaaaaaaaugaaucuguuaaaaucaggaauaccuaaauuuccaaguaaagauccaagaagacuaaagccuaaagucuauuucauaaaggagcuucuaaaaucaauuugguuacuuugcaggauucucaauauuauuauucucuauuugccaacuucauagucuccacaucucuaaccagugccuugcacauugucuauauucaauaaauauuaaagaaaugaacaaaauugacuguauagaccauguuucuuaguccauuuaguauugcuauaaaagaauaucugaggcuggguaauuuuuuuuuuuaaaaagagguuuacuugacuuaugguucuucagacuguacaagaagcauggcaccagaaucagcuucuauugagggccucaggugacuuccccucaugacagaaggcaagggcagccugugugggguagagaccacauggccagagaggaaacaagagacaggguggggugccaggcuuuuuuucugagauggaguuuugcucuuguugcccaggcuagagugcaauggcaugcucuuggcucaccgcaaccucucccucccagcuucccagguucaagcgauucuccugccucauccucccaaguagcugggauuauaggcaugcaccaccaugcccagcuaauuuuguguuuuuaguagagacaggguuucuccacguugguuagccuggucucaaacucccaaccucaggugauccacccaccucagccucccaaaguccugggauuacaggugugagccaccgugccaggcugcucuuuuuuuuuuuuuuucaaccaguucucaugagaacuaacagagcaaggacucacucguuacagugagaaugaggcaaaaaccauucaugagggauccacccaugacccaaacacuucccauuaggccccaccuccaacauuaggaaucaaauuucaacaugagauuugauggcgacaaaccauauccaaaguauagcaccaaguaucauacaccuagacagaaauagacuuggcucaaugucacaucugcugugacagaugugcuggacaucugguaguguccacucuauacaaaucugugauaaucaucagcugcugagcucucaaacaagacgaaacuguauaauaaucccuagagggucucuuuaacccagaccaguauaccacaaaaggaauauagugagaaugacugaauucacaugacagacugaaagcaaacuuaaguagacguuuauaugauuaucaccugaagaaugaugagguucauaaauuuggaaaggagagcuuuauuucuuauaaagggcugcagccugcagagugaccuucugacagguugggaagcauaacuuccagccagaagccagaaacagacacuucaagggagggaaaaaggaaacagaaauuuaugcuaagcacgguggccaaauauauauguucaauaaguuauaggaggagucaugaauauuuaugagaggagaagcaugcacauccucaacugagcuucaugccccuuugugggauccauguggaaaaaauggcgacauuagcaugauccgaggguagaguuuucggcccucugacauuaaaaggugaagcagaggacacaaaaauccuuacugcacauucucaguggaauggcuagaaucauucccuaguggguggucucuuaugaggcaccaauggagggaaagugucaggugguugguccaugucagugggggagucuuuugaaagggcugauuucuguuuagcccuuagggaagaaagccucauagugguuagugagggagggguuauaaggagguaugucugacucccugauccaccauggcugagaauucagucuucaagguuacucugggauccuuuuggccaggagaaggucaauucagucagggggcuuagaauuuuauuuucaguuuacaugauaaauuaagcauaauuuuauaucauaaaugauaaauaacauacagaaaauuuaauauacugaguuucugaaucaggaaauuaucucugccuuucaucuuucaagaccuauuuucuguaaguucuuucagcuuucucuauaccaaaaugguucuucucugaacaauaauccauaguaaccauugcagauaauaugccuuugcuuagacuuguucuaugucuagauuuuauauauacagaaucugaaccaaaugaauucugcagcucugauacuucuagucucaauuuuucauaacucagggagguuccauuugucuucagguuauuuggaaaagugaaagugucaaacaccugauacucauuccccaggguaguuaauuugugcucaacacucuccucuccccguuccuggaucuguuucucuuuccccugcaguuuuucucugcuucagccccgcugcccguggguucuaugcuguaucucuccauacagcaacuaugccuggacaguuuugcuuuguguugaggugguuucauaagaaugcuuuugagcagaagaguauuuuuaaauugaguuuaugcuaaagagaaaccccucugagcagaauuccacacagaauucugcaggauauuuccugcauaacaccauaaacauccuucuggcugcagcagcucaaguauuucuguugaaccauuucacacccugagcuaacuaacauucagagaaugaaaggugaaagucuuaaaacauaaauuaaauaacuaugauuucuuaauaacacuaaugacuaaacauuccacauagauccuaccaaaggaggguauuguaugucucccaggaacagagucuaaucauaccauuguugugcuggaacaccauugaguccaauagggauggcaucauggccaagagacuaaagaagagacuugaagccagcaagggagacauaggauuuaucuaggacucauauacaggggugguccaguggcagugggcuggaugggagaaccacuaauguuuguaaaaagcaugcaguuuauauagcauuuucacuuagcacucuccaccuagcaacauucauuuaauccaaacaaagggcuucauccacuguauggcccacauucugaggaauggaccaggcuuuggaaauccuuaauaauaaggagcaaauuuccagguuggccacuuccagccagauuucuuaccucagacuuccaaacacacauucuuuuuagaccacagagucauucucaggguacccuuaaauuauugcugucaggugcgucugccauacaaccaugaguccugaaaggauuugcacacugaaaacacugcauuauuuuaccaaaaugguuaucaaaguagauauuuccaaagaaggaauguaagcauccuuccucccaacccccaaccagcauuuuguguuaaaaugcuaguguuggcaucuuuuuccuucaaagggaauuguaccaagccugauuuuuucucccauuauugccccacagcaauaaaaagacaauugcugacucaggcacuauuuccucuggcugcuacuuauagcuacauaacuccuggcuuuaccagcaccauaggcaaaaaugaccugcauugucugagagagcagcaagaagaauggcauucauucugucuccaucuuuguggguuuacauuaaguuacuucuagaccaugguuuuugaaugaaauagaauggacuugaagugucuacaaaggagaggcacaguccagagugggaagggguggggagaggacagcaacggaagugagauggaggcugagcaaaaaaaaaaaaaaaaagaaaauugagaauaaaggagagcugggagagaaaagaugaacaucgagaaaggggaagaugaauagacuggccauuaggcuuucucuucgaguaauccacuuugugcaaaaccugccauauacaacuuggauauaggcagugccucucucauugcuagcuaaacagcccugggaggcccacacugggcuuuaagugccuaucaccucacacuugguaucucaaaaucugcaaccacaaucacagucacgaggauuagacuucacucucuacauccucccaaaucucugucgagugaccacucacccacacaauaagauuacuuauuuucuaacaggaaaacuuuacuaaaagagguuaacuuaaauaauuuacuuacaaugacagucauuacuauauucuugauauaaacuaaugacauuuguucaaaggaauucccuuaaauuauucugacuaugaucgucuagaagagauccuaaauuucacaugauuuauuaugugaacuauccauggucuuacucuuuaaugacaaucuucucuguaaggaaaaaaaugaaauuaaucauccuaaugauacugauguguuucaugagaaaacuacaggcagagccuaauaaacuauggcagaucugaaucucaggcaaaaacuauguacuguauuucuauguauuguauguagauugaaugaauuuuuugccugagaucugaaucucaggcaaaaacuauguauuguauuucuauguauuguauguagauugaaugaauuuuuuacuucuuaguuuauuauuagggugucuugaaaaacaccccuggaguauacaaauguagauacagacauauguuagauaucugaccuuauuuuaacugcaguuugcauaaggcaugaaaaacuaaggguagauaaugaaguuauuuuuaaauguaaaaguuuuaaacauauggcugaaauauguuguuuuaguuaaccccaaccuacuaaaaauuggcuuauugagaaaucaaaugaaauauuuuuguaauuauaauuacaccaaaucaaauuauuucuagaaaagaaauuuauaaaacaauacuuucuagguuugggauuucuauguaaaaaccaauuucuuucuuggcugcuaaaaaauaguuaugugagaucacaacaguaagaauaacauuuuaccuaguuauuuuuauuauuauuggcaguaacauucuuuuguaaaguagguggcaagaacacuacaaaacgaacugaaacacuucacaaauugucgugcccagaugguuuauguccccagaauaguaauagcucuuuacaaggagauggcaagcauuuuggcagaagucuuuuugguuucucuucaguauggauauuaaacuacuuuauagacagaauugaagauauauaauuuuucuccacaucagauuauauauuauaagguggugaagauauauaaauguugcacaacuauauugaacuuuggaguuacagauaaauuauauaaagucaucugcucaguuaguaacuagaaauaauccaguuuagcaauacauaaaacauaacggaaguaaaacauaaauugacgguggagguauaguucagcaggauuaaaaccugcaucauaugauucuaaacuugaauauuacaaucaucuuuuuaaauuuuggagucucccauuuuucaaaauuuugaagucuccauuuuugccagaaugcuuuauuuacuguauuuguuuugggucuguccaaguaauauaaauuccuuggagagaccuagaucaauuagaguagauaaauacuauuuuaacacagcuacuuauauuuucauauauuuuauuuagcuuuaaaagaauauuucauaacuauuaggaccuggcagacacugguuugggaguuagaaaauaaaaguucugauuuaagucccaccauuaauaagcugcguaaccugggacaaaugacauauuuauuuugaaaguaggaagcacauaaguucuaaacaaagaaauugcccauuuuucuuugauucaguuuguuuucuauuaaaugagaggaauagacuaaucucuguuuuuuaaaucuuugccauuuauugguuuugauuuacuuaucuuugucuaauucucuuaaaauaacuuacucaaccuuucagaaguccagaggucaagguaaacuaggucuugucugccugaaagccuguauuauagacuaacacuguuccacaucaacaacaaaauacuaucacauuaaguacuauauauauucuugucugugaauaaaccauaagagcugcacuuuauauucaguucacuaaucaauugguuaguaauuuuuuucccuguaaaucacuucuagggucagauaaggcaaaaaaauaauagcaauuauucuaauagaucauaacaauagcauuggaaacugggaggagaaaaugagagaauugucucaccagguuguagggagagacgggggagugaggagggggaauuucuuuuaggcuuuaaaaacaacauagaauuuaaggacauuauugaaccaaaaaaucucaagacauuaccuuaguuaugguauuucuugcauaaauacacaauggcaucagagugugaaguuguggaugcugggugucucucggggaugggaaacacuaaauuucauucaucuuucucagguucugaacaaagaaaaaauauucagaggacuaagacagauaucaccuuuuuaucucacagaaguuuguggagaguauagcuuugugugaaagcccaaaagcccguuaaccaaacagaucuaaccacagaggcccaagcagucacacagagcugcccuccaaaggaagaaacuacauaaugauuuacuuauaaaaggccaguuucuucggguacaaagcauuuauaagguugccuuuacaguuaagacuucugugugaaaugccacagggaaaaugaaauacuucauugugagcuaucguacauauuuguuugacuggagaaaagcagaugcccaagggaguuuaacuguaaggcuucauggguuaggauuacuuuaaauaaagcuccuccaucugcacuuugagggucaccaaagccauaugguuuaccacucccagucaccucaaguauaaacaucuuuuggcugugauaaaugccuccucaaguccagaacguaauacauguguccucuucuacgggaaacagagauauauaaugcccagaagcaaaaaccucaucuaguacuagaacauuuaugauaaguaaugaauuaguaaagucuuagaaaugacacugaauauuaucaguauuaacuuucugaucuuguaaagucucccgagaagguaaucuguuaauuauaaugcuacagauuuaccucccucuuuuucuuucaguuagauauuaccagaugauauuauaucuuuauuuauuauuuguauauucuaacaaauuuuuccuuauaauucuuuuguccacguuauuugauauuggucauguuauugcuauuacuuuacuauuucuuuccacucaaaauuuccacuucauuuucuuacaaucuuuuuuuucccccaugaucucucacuuccauuucauguucuuuuggauuauuuuuuuccugucuucuuuaggauugcuuaucuaauugaauuccacuuuuaauguauuuuucuugucuuccaaagaaucauucuucuuccaguuuucuauugcccacuacucuacuuauuuccaauauuuuuuaaaauuccuucagauuugaaguuugcuaacaugcacuuuguuacuuuuucuuccuagcuaugguuucuuaguucucuucuuaauuuuauuuuguccaaaugcauaaccauaaucaucuugaaaaggccucucucuuugaagucuucucuuguuaggaaaguuucauugucuuaccucuuuugaaaggagcaaggucuccucuauguaaccaaauauuuaaaugcugguuuuuaugaaaagagaaagcuguaagccaaaacugcagauucuaugagguuacuaccccguaucuagugacauguauuuucauaaauuaggacaauuaagucuucuguuauaaauuuuuagaauaaagaggugaaaucuccuuuguaaguguaaauggaaaauucaugauuuauuucuguauuuuaauagaauaaguacagauuucaaauguaauuuagaacaauuuuucauauuacuaaaaaauauuaauauugaaugacaucugacaguuuuuuagguauuucauaauuaaccuuaugagauuuuuaaugaguuuuauucuuauaauuaauauaacauaauuuauuuuuagguagcauuugaauagaagaucuacuuagaguuaaaaaaauacuuuuucuaguaucaguaugauuucauuauaauauggguuauauugcuuacauaugaauauaauuccuguaucuaacuaauuuauaauuauauauaauacguuugaacugaucauauuugucaguguagaauucaugucuucuacuuucuugguuguuuauuucuccaguaaaugauagcuagugaccagggagauuuucuuuagagagcuuuucucaaaugcaguauuucuggagaauaggaaggcuuuuaguaacuguuucuguccauucacacaacuucauggacaauaacaucaaguguggcacucugaaagacggugauugucguaaugaucacauauguuaaaauauaccuauauaugauaucuaaacauauacauauuaaggaaagugcuaaaacaguaaaaugaaaaggaugaaaccgaauugauggaaaaagacauacuagauaagugcaaauaaguagaaauuaaagucauuauaugcuaugagacaaaguugucuuuaaagggaagaaacuacaguaagauaaacaagggccauuuaaggaaguacaggguucaauucacuccaaagaucugaucauaaguguuaucuacacaucaaacaauaccgcauuggaauucauagaacaaaaaugacagaaaccacaauaaauaaaaacacauuaaauagacauuaauuugccucucccaacuuggaacagucaaguagaaaaaaaauauguacagacauagaaggucuacauaagauaagaaauaagaucaauauaauugaggcauaaugaacucuacugcuuuaaaauaaagaauaaguuucuuuuuaauguucuuagaaaagucauuuuaaaaacaaccucuauuaggauaaaaauaaaucacaauaaauuccaagaaacagaaaugguacgaacuacauuaucagagcauaggguaauaaaacuaaacauaaauuuaaaacuuagaaggaaaaucuaucauuugaaaaauuuaaacacuuucuuuuaaauaguucuugcaucagugaggacuuugaaaccaaaauucauuuuaagaauuuucugguuauucuuguuugcuuauuuuuccacaugaagucucaaauagauuucucuaguuauaugaauuuugugauuauuuuucaaaggcugcauuuaauuuauuaauuuagggaaaauuaauaucuuuaugauauagcauuccuaucuaauaauaggauauaacuuuccauccauuuauauuuacuuuugguuuauucaaagcuuuuaaaaaaugcuuacauuguauuuagaaacauuucuuccauuguacuuuuucucuuugaaauagacuaguuuuacaguaguuuuagauucacagcaaaauuaagccaaaaauauagaguuuccccuuucucuacacacgcagagccucccccaacuaucaauaucucgcaccagaguagcacauauguauuacuguaaaaauaaucuauuuagaagagaaaaaauacaauggaagaaaauuaauuuaggaaaaaaauuaauuuuuucccuaaauuaacaaauuaaacgcaguucaaauauaccuguauuguauauagguauauuuuaacauaugugcuauauuauauguauuagaaucaaaguccucuuugauucaagagcuauuuuagagacaguguuuagguauuguauauaguuacaacugaugaacccaauuugauauaucauaaucacccaaaguccauaguuuacauuauaauucaaucuugguauuguacauucuauggguuugcacaaauguauaaugacauguguccacuauuacagugucaugcaaaguauuuucacugcccuggcaaucacugaucuuuuuauugucucuguaguuuugucuuuuccauaaugucauauaguuggaaucauacuguauguccauuuuagauugcuucuuucaauuaguaauauguauuuaaaguuucuccaugucuuuucauggcuugauagcucauuuccuuuaaugcugaguaauauuccauugucuggauguaccacagguuauuuauccauucaccuacugaaggacaucuugguugcuuccagguuugggcaauuaugaauaaggcugcuguauacauccgugugcaggauuuuguguggacauaaguuuucaacuccuuugguuaaauccuaagguaugcaauugcuggaucauaugguaagaguauguuugguuuuuaagaaacugcuaaacugucuuccaaguugcuguaccauuuugcuugcccaccagcaaugaaugugagcuucuauugcuccauauccucaucagcauuuaauguuguuaguguucuggacuucgaccauucuaaugaggguguagugcuaucuuauuguuuuaauuugcauuucacuaaugacauaugauggauguggggcaucuucuucucauaugcuuauuugccaucugugugucuucuuuggugaagugucuguucaggucuuuggcccauuuuuuauucagauuguucauuuucuuauuguugagcuuuaauaauuuuuugcauguuugggguaacaguccuuuaucagacaugucuuuugcaaauauuuuucuuaguauguggcuugccuuccuauucucuugauaguaucuuucacagagcaaaauuuuucauuuuaaugauaucagauugucaauucuuuuuuuucauggaucgugccuuugguguuauaucuaaaaagucaucaccugaguucugguuccaaaauggcagugaagaagcaagcuggcacaauuccuccucaccaucacuccuagaaaaccaaaaacaaauauauagcacugagaauaucaccagaaauauuccagaacucaaauaugaagaugagacaguuccaagaaaaacagagaacuaaaaaguuaucaacaaauuuagucaacuagguuuucuccaauauuaucuucuaguaguuuuuuaguucugcauuuuacauuuagauuugugauccauuuugaauuauuuuuugugaaaggcauaaggucuagguucauuuuuuuuuuuugcauuuggaugucuaguuauuccagcaauacauguugaaaagacuaucuuuucuucauuuuauuaccuugcuucuuuauuacagaucaguuggcuguaauuaugugggccuucuuccacacucacuauccuauuccauugauccacuuaucuauucuuuugucaguaccacacuguauugauuacugcagcuuuacaguaagucuuaaaguuggguuagugucaguccuccaacuuuguucuucuucaacauuguguuggcucuuuuggguuuuuugccuuuccaaauaaacuucaaaaucaguuuaucaauauccacaaauaacugcugggauuuugacagaaauuaaauuaaaccuuuaguucaaguugggaagaacuagugucuuugauauauugaacacuccuauucaaagacauggacugucucugcauuuauuuaguuguucuuugaucucuaccucacuccauauagaaaauaaauuccaaauagauaaaauauuuaaacuuauaacauuaaaccaccaaaauacuaaaaauacaagagggaaaggugauacagaugcauguguguguauguauauauuuuauauccuuuuuccuaccccuuacugcccaucucucuggaugccuuucuaagcauuauacaguauccagaagccaaagaagaauuagauaaucaccuaacaauuuuaacauuuuuaauuaaaucuuuuaaaaucuguagcacaaagcaccauaaagucaaaaaauauacauuuuuaaaagaccacacaucaaaaaaucaaguggcuaauauuuugucuuaaaagaugcuauagauugaaaaaaauagaaggaaaaaaugggcuguuuuuaaauaagcaguugcaggaaagaaaauaaaaaauaauucuuaaguauaagaaaaauauauuccacuuuucucauaguaagacaaaugcaaauuaaaauuauaauaugcucucaucuuugucccugucagauuggaaauaucaaaaauaugauaacauauuauauuggugaggauaaauaggcacucuguuacauugcugucaggagaauaaguucauacaaacuccauagaaaguaguuuugcaguaacuaucauaaauaaacauucuguacaaagccaagucuaccuuuaaaaauuaauuuuauaaauauauccacauauauuugaaaguauguguguaaaaauguauuacuugcaacuuuauucaauauuagcuaaagauuggaaacaacccaaauacucacauucagggaauugguuaaauaaauuauggcacauaacaugcaauggaaacccauguagccaguaauagguacgagucaaaucuauaaaaauuaagauaaaugaacucuaauauacauuuuaaguaaaaaaugcugguguaaaacaguuuguauaauaagauuccauuugaauauguauuuuaaaauagaauauguauacauacacucauguucuagcauauaccuauugaauaccuggaaauauauaugggagauaaguaguaguaguugccucuaggaaggggaacugggccuggggaaacaagguaaaaaggagauauuauacugcauuuucuuuuagauauuugcauuuauaucauuuacauauauuuucuaucaaaaagcuauuuaaaaauaaaaacuauauauauacaucagaauauuuuauuucccuuuugagaaaaguuacuauauuuguuaucccuaaacuuuuauuugcaaaaaauaaauguuaguauuuuccugaugccuuguaggggaaccagaguuuguagacagaacauucaguuuucauugauuuacagacaaccuauucuugcagguacuaaauaacugcagguuaaguucuaagaaccgcugaaaacuucacuuaguagacuaaggguacaaauuuaaacuugaguccucccuucuuuugaucauccacucugaaaaauaugguuauaaaccucacaacaaugagaaccuccuugaaauuugaggucucugucccucacaaaauaauuaugccugcaauuuucuuauuguaguucauauacaccaaagcuauaauuaacuguaccauagcuugcugaccuuaaugaguuaaugcagucuccaaauaaaauucauggccaaguggcagcuuaggcucuggaauauuuuggcucaguaauaucugugaaaucugagcucauauuaaauaugccuuaaaacaauacauuugggauuuggcgucuggcaucagaucaggucugacucugcuguaugggguugacgguuuugccucaggccuucauaauaugguuagcacuauaggacuauagaaucagcaagaauuucauuauugcuucagugaagaaaaacacuuaguuucuauugaguuuauggcacccugacuucuuucugaucauuuuucuugaaacaggagacuccugcugucuccugcaccuacagcuaucuucuuccacccccaccuccaucuagcaauuucuuuacagccuaguuuuccucuccuucuuacucacauaaaugacauuuguccaaccguggacugucuuuaucuuuauguguucaaguaagccaaccaugcauggcuagugaagugagcaggacauaguuccaguugucucaaaucuuagaagagguuaaagcccagucaagacagcaauaacuauuugauuggucauuaagguuggucacugcaaacuauccugacuaucuuggccaggaaucacuugucagaccuagaggguuagauuuuauguccucucagagacaauuccuuuuccccucauccuuguuaaaugagcuauccuuugccuuuauacgcacagucuccaucuucugggugugucacagacugaauaacucauuagugauauaguguuaauuagccuaauguacuuugauuaaggccauauuugaaccacuuuuaaaacucauggcacaguuccuguaucaguaaagcacaagaauuaauaaauaagugaugcuuaacuaaacucaacacagaaaccauuuguguuaaaauuuuuucuuuagaaaucaccuuucaauuuaaggagaaaacagacuuuaaauccucuagcucauguuucaugacaagaauuuauuuauauuaacaucucuuaguccacucuuuaaaauaucuguauuccuuuuauuuuaggaauuucauaugcagaauaaaugguaauuaaaaugugcaggaugacaagauggagcaaacagugcuuguaccaccaggaccugacagcuucaacuucuucaccagagaaucucuugcggcuauugaaagacgcauugcagaagaaaaggcaaagaaucccaaaccagacaaaaaagaugacgacgaaaauggcccaaagccaaauagugacuuggaagcuggaaagaaccuuccauuuauuuauggagacauuccuccagagauggugucagagccccuggaggaccuggaccccuacuauaucaauaagaaagugaguguuuuuuaucaggcauauuuugcugcuaauugccuacugcauuccuuggacuguuguagcaccaacacaugccaaauuagcacaaaaucuuaaguauccuucuguuuaagaaaugaaacacauuugugggugguuuaugcauauacaugagaaaugaauugauuauaucauaacauaugcaacugucccaaaugcaccaugacaaauaaaaagaggccaggugcgguggcucaagccuguaaucccagcacuuugaggggccgaggcaggcagaucacgagguuaagagauugagaccauccuggccaacauggugaaaccccuucucugcuaaaauacaaaaaauuugcugggcgugguggcacacgcauguagucccagucacucaggaggcugaggcaggggaaucccuuguugaacccuggaggccgagguugcagugagccgagaugacgccacuacacuccagccuggagacagagcaagacugugucaaaaaaaaaaaaaaaaaaaagaaagaagagagggugggagggaaggaaggaaggaaggaaggaaggaaagaaagaggcagcuaauuuaacaaauugacagauucucuccacagauucgauuuacuauacaauuuuuuuguacuuucuguacuuggaaauacuuggaaaucucaaaaucaugaguuauaaagacuauacaaaauauuaguacuaauuuuucaugcaaacaaauuugaugccacaaggguuugcaauuucaaugucauguuauaaacaacaaaucaauuaauuuccugaagaaauuuuguuaccuguaaaauaacauuuuuacauaaacuagaauuuuacaaguuauuuaauauuuugguauuaauguacuaauauuggcaagaauuaacaaaaaugucauaaccugaagaaccuauaaacaauauuugaaugcgugcuuuuuucauauccaugcuugaaaugaaucuuauguuaagcauccaaccguucauuaugacugucauuucaccaaaccaaaacaaaaagcauaaaauuuuuuuuaagauuauugcauugauuuuaaauuaaauguaugacguuaggugauucguaacauuuucuucuuuaucacuugacacaaugcauuugugaaucuuaguggaaagguagggcacaaagauuguaauuaaguaaauuuuuuuguuggaccuggaccuuaaaauacccccuaaacuuuuagggacucuguuucuggcccaguucugugugaaguuaguccuugccaaaugcaugcaaaaguuuggcauuuguaauaugugaauuugaggcaguuuuauaaaucacuuccgauugacagcuacaguuucggaggaaagagcgucacaaaagguugacuagccuuagguucagauuuuuuuuuaacuuuucaggauauagucaguuuaaguauaacauauuuucccuuuuuuuuuuuucuuuuugagacgcagucucgcucuguggcccagacuggagugcaguggugccaucucggcucacugcaagccccaccucucggguucacgccauucuccugccucagucuccccaguagcugggacuacaggcgccugccaccacgcccggcuaauuuucuguaauuuuaguagagacgggguuucaccauguuagccaggauggacucgaucuccugaccucgugauccaccggccucggccucccaaagugcuaggauuacaggcgugagccacugcgcccggccaguauuuuccuuuuuuuuuuuuuuuaaacauuauacaacuuuaauguuacaccaucuacaaaucuaaauuacauuuaaaauuaucaguugacagugguacuaggauuuacuuuaggaaucacuacauauuuccccuuuuuaaaaacugaucuauucauuuuacaguagaggaagggauggaucauuuuccauguauuucauuuuccucuaacuuugcuuuugaacaccauauugucaaaucuuaguugauaagagauuauuaaucucauaacugccauuuaaguuaugagaaaaguugcacuuuauuauuuaaucaacucuuuggaaauuaauguaucugaaaagccaaagcccaaacuaaacaaacuacaaggacuuuauuuguauaagaaaaguaaaaaugcagauaauccaauugccuaaacauuuuaauucguuuaaaaugacuucgguauugaagugaagacugauguguuccaggcagaaauucauucacaguauagaguaugcuacuguauuuauagccauuggauacuuuuaguuuauucagaggcugcucuugggauauguuagugggcuccauccucaacaggccuuuugcuacccccagacaccggguccucaccucuuugguagcaaucaccaucuaaaaauuauuaaagccacccagcaucuaucccuuaaucaaacagggaagaaauuuaguaucucugcuccuaugcuggguccuuauuuguaaaauaauaaaugaauguuuugagaaagaccaaacuaaugcauguugacaaagguagacauucuucaucuggaaaccagaacaaccaaucaaucuuuuuuuucuuuaauuaaagagcuuucagacugauaaaagugauugucucgaggggaugucccuaaacaaaaugguccauaauugguuuauaaugaauuauauauagcaaaggauauaaagacagauguaaaacaaaauugugcaaacauuuucaaaauacucaaaagaaacaucuuaaaacugagggugaaaggccaacucugaugaagugacagccagauucuugugucgaggaaacccuuauaaacuuuguuaggcucacgucuaaacuugcucuuaacaucuucuguucuuaucuucaaaugcacaugguaugaggaaagaaaagcauuuuggcauuuuggagcaaaucacagugugcaaguagaacaaccugauaagggaaauauuguuaucaggaaagaguuuuccccaagguaagguauacucauggcuuuuacauugaacugacagcaagcaaaucuucaaauguaagucauucaacagcaaugcacacgaagcuuuuugcagggcugaaauccuuaaaaacuaacauggugugcuuagaacacaugauugaguuauguguuugaaauuuccuucuucugcauuuuuaugucuuaagacuuuuauaaguugccuguacacuuuuuucugccuuuaauuuucuuuucuaauuggauuauuucaguauugaaaaauauccuuaaauggaauuaauuugcucugacuaaaguuggaaugcuuagcaaaaucugaaccuuuuaaaaauaaugaauauuucuuucaauauucgaugacuaauuuuacuuuagugacuggguuaucugagauuggcugggugaucuucauuaaaacaaugcgguacacauacacaguacucuugacacagcuaaauggucaaacaguggaaaugucaccagggaaaauguuuauuaggacgagauuuuccacuaaugcugauacuggggguguggauuagauuugccugagugaaauggaauaugcaguuagacuagugauuucccuaaaguuggacucuaguacaauaguuaaugugucauuugcaucaguauacaaagacucugguuucuuucucaacuauauggaauagacaaaacaagccaauuguaaaaauauuugcagaauccauuccuuauguuauauuuuauguuaaagugcaguaguguacaugcaaggaauuuaugugaauagaaaaaacacaaccaccacacugaagcucucuguaaucuuuuacaaaggcagugucagugagcuuauuaaaaugucacugcugagaguauauuuuccaauggcauaugcccacauauuuuuauccucuuugucccaguuuaagaugugcaaauuauguaauguucaaauauucuacuaaaauuguuaaagcaguuuaauccauguucaguaauauuguaguaguaacuaaagaaauaguagcaucuaugcaucaugaacauuccugaugcauagaagcauuagaagguuuuuagauccucagauguuuuaagccuucagaguuccagguuaaaaacucaggggaaaaaaaugcuaucauaauauggugacaguauuuuucauaucauguuagcucugacucaguggucuuuagaacaugauuccagauugguuucccuuuguuuguuuauuuacuuuagcuguguagcaaggcacauuuuagcuugugaacacaccuuuuuuucccucacgggacuuuuuuucacaguuuccuuucauagcuugggcugauuuuguaccauuuggcccuacauucaaauucuuuacccacucuuuauuacagaaaaugucuuccuucucauguucuuguuaaaauuacagacgaaucauuauuaccauggaagaaaauaucauuuuaacaaugugacaguuuacuggaaauagaaugagacauuuuagaucuguaguaaaaauggauguuuguuaauuauggagugcagaaaugcauucauuuuuaaaaaguccuauggaucauuuaaaaguaacuuauucucucuugcuaucaacuguccugaaaagaugcacacucccuuuuucuugggcuccaugagaagucauauaugaauuugugauuucaaauucauguuuggucuaucacugccaaaggaguuuuuaguuguuaaauuggguggagagaguuuguuuuguuuuuaauuggaauuauggaguuuuucuugcaaaaguaauuaacgggaaaucagaaaagaggaugauuauuaaaagcuuauaauuucacgaauugucauaugggcaguccccaguguguagcuguucuuugcuuaucaucagcuccuguaaaacuaaaagucacccagacucucccuuacauccaggacccuguaguugacuucccaaucuuucucuucccuaugcacuauuucuuccuugugcuucuuuuuccuuugucaccucccugucucugucucagaaacagucccaagauggugauguugaucaauaaaaugaugcuuggcauuuuuagaguaucugccauaucuauaggagauccuucaacugaaaguuuccaaaacccaacagaaacaacuuuuggggaaaaauaaaggaaaugugucuagugaaucugguuuuaauaucaaaauacccaguaccucaaacaaugucaugaggguacuccuuuuccauggucagcucugcugucacccaugcuggcuucauuugcaggcuggcucuuccacaagauggcagaaauagccaccaguggugcuaaacuaacauccuacagccuuguaacuacuaucuucugcuaaaacaagaaagaagaaagaaaaaaggcccagguuuccuucaaaagcucuagcaguuguccuagaauugagucuaauuaggucacauggccuccucugaaccacucacuuuggcuagugguaugugauggucuccuugguaugggauggucucugucauauacuaaccuguguugccaaggggugggucagcuccaccaagccacaugggaagacaguggggcagagauuuacuccaaaaggaagagaagaggaacuguuagaaaagguguccuaagcaggcaaaaaaaaaaaaaaaagcuauguacucuacaugcuauauauaauaucaguauaauuacuguucuuuuuuaauccacagauucuuucaagauagcucuugucuuuauuuaaaaauaauaaaacugaguuuaaauaacuugccuaagacuaguuuuaaaacuagaccagugaguuuccauggcccauugccauguuaguuuggauuugcagucauagcacuaaucacagcaguggaaaaaaaaaaaagagaagucagugauggaaucuaaauaagccuauagcuguccuuccuguuuccuacucaugccauuuugcaagaugugauucuggucucccaggccggcaguauuucccgaacccuuacuggucauuucaacacuuggccauuuccugccuuuguaaaaccuuauuuauuuauuauuauuauucauuuuuaucaacaucaccaucuugggacuguuucugagacagagacagggaggugacaaaggaaaaacuaaaaucuuagacacucagugaucuagauuagcuucuaaaauaauuagaaauuuuuuuucccacuaaauuccaguagggugauaagcaccuauuuucaaagaggaucaauucaggaaauuuaaauugugugccucuauaaggaaauggcauuuaaauugggaucugaagguuaaaaaggaggagggagaggagaaucuuccaaggaaagagaacagcauagaauaagacauauaaucaagcugaccuguaauagguaagaagagaauaaggugagguuggggagguagaccuggggcuagauaaaggggaucuuucaguacaucuuaaagaguuugaagguuaucuucaaagcaaaaugaauucccaacaaguauuuagguacagcaguaacaugguccacuuuacauuguuaaaaaucacucaacuucucuauggagaaauuuaggaguuuuauacuugaucuagcauuuugacaauggagauggagaauaauggauagagucagaauugguuuuggagguguuuaggugucagacagaaggaagcugauggccucauuuucuuagauaggaaguuugagaagaaagauacugaaccugaaaauuccaauacuaaaauuggccaugcuuuggagaaacagaaauguucuuauauguguauauuuaagaguuagaauacagagacgcauuuuaaauauuuuaauccuuauauuuuuauugacacuuuagaauucacuaagggcauugacauguuuuauuucacuuuauccucaaaauaauccuaagauugguauuaguauaaucuucuccauugagauggagaaauugaggggaauaguuugcucauaguucucacacagcaagcuuguaaucaagcugggcucaaaaguguucuuuccagucaaagaaaaauuaacugaccauauaauaguguagcagacccaugguauguacauucugaugauauagggcugaaaaauguuucagcuccagauuuuauucuuuuuccuuguuguuauaauuucuucucucugcuggagaagagguugagggcucugcagccuuggcugacaaaagccuaccuaggcacuuucuagggaggcaccuucugcagaguuaucuccuccacuggccccaacccuccacccagcuaaagcauaggaacaagcaauuuuacagacucuucucuagguacaaauucuucucuuuugugugagcauauggcaacaauguuuaaaaacugacugugaggcauggaguccacagacauguuuuguuaaacuaacaaaauuauuuauaauuuugaauuauuuucuggcauuuauaaaucagaaaaucuuucacacacucauaaaauuauacaucuaaggauuccucuugaaauaugaguucaggcaucacugacuuauaugccuaaaacuggcagguaccuauugucacuuagccucugugggcauuuuaguuuguaaucuguggcuuaaggaccacaucugucauuaagugaaggcuauauauuaaagcuugguggcccacggguaggcaagugacacagauuguuguuuagucugguuaucacugguuggaaggaaaaaauugaaugagacuaggagaugaaaaaauauuaaauauggcauacucucuucagagucagguagaaagccugcaagaaaacuuuucaucccccagugagccagaaaaggaagaaaagcuuggcuugaacucacaggcuaugacaaaugagaagggaaguaggugagaccauuuaaaguccuuggggaaaaaauauuauauaccauggaauugacccagcauaagaaauguccccagagauauguauuauacuaauggaaucuccugaccaucuaugcugcucuucacacccaaaacuuugaagcaucucuccucuugcaacauggcucuaauucucccccuucaugcuggaaccucuuuccaagccagcagcuuagagcuaugaaaaacuuaauagcacuucuggguaggagcuagagccagauaauuuuccuggucugacuuccaggcuauuucaaggacagaacucugccauuuucagaguaacacuuucuuacacauagugauaaaguuucucagugccauucauucagaauuguacuucauuaacaguuugauagaccugugggucuagaaauauauguguaucugugagaauauauguucacauuuccaaacaauugacuuccaaaugcauuucuggagcacagcucauguacaaguuggaaauugccuguuucaaacuuugaagcuaaaggauaaauuuaaccaaccaguaguauauucuacauuuuguguauuguucaucaucauagcucaccuuccuguguuauuucuuguuuuugccaguagauuuacuuuaagaguaggaaagugcaauaaauuuggagucaguccuguuauuuggcaauguuucaauaauguuuagaugaaacacaaaguuacagcuuauguuuaaacuauguacuuugaagaauauggccccuagauugaaauaaauguuaagguaauggcuauauuuaaaugagaaaaagaaacuggaaaaccauggcuuguuaaauucaauguccauccugggaaaaaauuguaaacaaaucacuuucuauaagcccagaaacaagaaaagauuacuagauaauaacaaauauagcuucauaaauagcaauuucuaccaaaucauuauaacauaauuauuuucuuaguaacuauucaguuagaucaaggggcaagauuucaauccacauguacaacauaaucauugauaauuuggccaaugguuugugauuuuuuacaaccauuagguaacaaacauauuaacagcccugcuaugacagaaucaucuggauuacuuauuuaaaguauaaaaacuagguaucaaaaucugaccagcuaaauuggaaucacauuaccucuaugagcuaaguacauuuauucuguuuucaagugagauaacugagucacagaaaguuaagaaaccuguuccggaucacacugcuggaaggcagcaaaguuagcuuuugaaucagaaaucuaauuucagaguuugcacccuuaacauaagauaaaacaaaucauacuuauauuuucauaauguugcuucccagauuauuaaacuguuaauuaccaggguuauuaccaauuuuucuauauaacuuccuucuugcuuuuucuuuaaaaccagaaaugauuuuuacauggcaaggauugcugaagaagguaugagcuugcugaacaauggaugguuuaaguuuaggucugugcugcccaauauagcagagauuaauuagccuuguguagcuauugaguauuugaaauauguaaguguaacuccauauuucaaagaucuaagacuuaguauaaaaauauacauaucucaaaaauuuuuuauaucaauuucauucccaaaugauaauaauucagauauguuggguuaaagaaaauacuguuaaaauuaauuucaccugcuuuguuuuucuuuuaauguggcucucaggaaauuuaaaaucauaacuguagcucagauuuguagcuuacauuauauuucuguuggaaagugcuggucaagguaaccuucaucaauucuucuauauucuauuaaaacaaauaguugagcaucuccuaguuuauaaaugucuuggugucauaaccuauguaucuuuguuuucucuuuagaauguagcacagggcauugcaaauauuguacuaaacaguuaauacauguauucugaauugccaucaauugaaauuaacaauuggaccuaaacuaggucccugcucauacauaauuaccaacuuauuguauauaugcccaauaaacuugguaccuguauaugaagacauaagugacaagcuagaacaacccuauuguaugaauguuacauuccugcaaauaagucuguaaagugauuuuucauauauaaaaucuaguuguuaccucaguuacaaugccaugcuucaacauuuguuuugaagcagaaaauuauccacguguuaaaaugauguuauuaauuucaaacaguucuauuucuuuguagaacugcaauuaaagcauuuguuuuggcacuaaaaugaacugaaggacaaauauuaagaauagucauagaugugccugaauuguacuaaaccacaaagucuugcugcuuguaaguggagccagucaugucaauguuccuaugagccuugggugguaaaaagggguuuguuuugggcuagauacuacuguauaaaccuuuucuccuccaccaccaacuuugaacuguuucuuuuuuauucaaaugacuuaaugcaauaaaaguuauccugauaaguuguauuaaugaaaucuuuguugaacuaauuagauuuaaaggaugcuaagauacuucacuauaauaagcuaaccaauacauucuuuuaaaaaguuuuuaaaaagucacccaauuuaauaguucauaaaucuugauuagcuuaaagcuacacaauauuuguuuauacaguuuaagguacagcaauaucuuagcuagucuuugaacucuucccucuuggagcccuuucuuauacguauagcggggaaggcaaauauuuauauauuugaaaacucuagagcuacuuaaguauuuguuguaagcaaacaguauuuccuucagacucuucccucccuucaauaucaucaaugccacuuuugggagaaagcuguaucugagaguccuuggaaacaaguauccuuuuauuaauucuuaacacuuauaaacugaaugaucggcuucuuggcuauguaagcaauuacaaggagguaagauacagacaguugaggaaauaaacaaacauaagaucaauuacauauaauaagacugacauucuaaauggaacuuacucugacaugaaagugcuaucauauuuaaaauuauacauauuggguugcuauacaagucuggguacuguugcuuuauuggaaggcuguuuaaaauccaucaauaccuuaaagcuacaucuaugaaguuuguacauaagcauguauguuucaaucugagaaaaauggaguucucacagaagaaauccuaugaaaaaaugguccuuuaauguuggccuuauuguuagcuuccuggguagcaaggaugucuugcacaacaguaugucuuaugaaaaauuaaagcaaaacaaauaccguuguucaguaaaaaccuuaccaauuccauuuauaaauucaacuugcaaguauuuuccauugcacauauaaaucuuguuaccaaauaaucuucuacacauucuuuaaauuuuuaaaaugaauaaagggaauacacuguaaaaucaguaaauguuuucaucuaaggcuugaacaauugauaauuaugcccauuuguuuuuaacuuuugugucaaaguauuaauuuucucuaugucaaaggacuuuuagauuuagaaucacauaccaacauugagagugcuuugguuucauuaaacucaucuuacuuaguuucagcccuuuauaccuccuuuuaucuuauuuuuuaaauugacacguaauaauuguacauauuuaugaagcauauagugguuuuaauacauaugauguauagugaucagaucagaauaauuagcauauccgucaucucaaacauuuaucauuuuuuguguugggaacauucaauaucuuccuuccagcuauuugaaacuauauaauaaauuauuuuuaacuguagucauccuacagugguguggagagcuagaauguguuccuccuaucuaguuguaauuuuguguccuuuaacagauuucucucuguccccaccuuuccccgauuuuugucuagaauccucugcucuuuuuacuucuaggcagacuuccuuuuuggaaccuuuuguguuugguuucugaaucuugccucuuuuacuuuuuaguacucagggcagaaauauuuccccucccuucuuuuagaucucuagcuuugccuuuuacuuuaccacuccuugucugucuuuucuguuuuggucauuuauuaccucuggucaugguuugggcugaacaguggccaaggagccagcaucacagguguucucuucuaaguaugguccugucuccuuaggaugagccugguuauuuuccuuauccacggagguacaaacaguaccaucuugauuauccucacacuccagcccaugauuuaggccaucuauggauugucauuucuuucucauuaucucuuuguaucacuacuauuuguuucaaaauuagcuuuuaauauuaucugaaaucaagagauucuuauuuuaaaauauauauauucuguguuauauuuuuacugguucuccuaccugugccccuaauauuucuuuuucuuuuuuucagauggaguuuugcucucaucacccaggcuggagugcaguggcgcgaucuuggcucacugcaaccuccgccuccuggguucaagcgauucuccuguucuccugccucagccucccaagcaacugggauuacagggacccaccaccaggcccagcuaauuuuuuuguguguuuuuaguagagaugggguuucaccauguuggccaggcuggucucaaacuucugaccucaggugaugugcccacuuuggccucccaaagugcugggauuacagacgugagccacugcgacuggccaucugagccccuaauauuucuuucagauuuuacucagcauaucuggggggaaaggaaguauaugcaguacauuugaaagguggaccauauuuauuccugagcuagcucacuuugggccuuucugugucguuacaugcucauauucccccacagcaaaggcauuugcauugcacaagucuguucagauuuacgaugaucucacaaugucauucagggacagaaucccucaaugaaucagagaaaaagagggcuaaguauuguuggcauaggggauuguucuucuaguaagcacaggugaaauucucccuuccuucaaaugcgcuuugugguaaagcucuaucuguuuucuggacucauacuccuucaaagaugauagagggaaugcaggcagaggugagacuuggagcagugcuucucaaacucuguugaggaugugaggucucuauucuucuauaaaaugaaguaaaaauuaguuucuagaaaacugaaaugaaaaacaggcccacaacaacaucccccuacuuuuuuauuauuagaauagacagacacaacauuaauuggccaaauugccuuacaaauuucuaaacauggacucuccauaucuauacuuaaccaguacugguugggggaccauacuuucacagccaguuuaggacacuucuacccauaccagauagaaagugcuuaauuuucaaaaaccaacuccauuagcagguaggggugugggaggguggguuugcuuuacuugaauuuagaaaauccugcaaguauaggggaaaucuguuaaugagcuaagacuauacaaagauucuuaguagaaaauaaacauaacauuuaugcuugcuguaucauaacaugaucugugcagauaugcauccuaaggcuuagaaaagaaagcuuucgaagaaugggugaauuuaaaaucaagaagcuuaaaauuuccuuccccaaauaugcucuucacagagauaaaggcuuucucccuggcucugucuaaauauaaguaagcaccuuggaaaacauugagucagagcccuuuuuauacccuuacauguugcuucuuuaauguuuugucugcccacugccaauugaucucaaauaagucuaauuuuuggaaggaauuucauucacauucauggauccuggauucuucaggagcuuggagcuucuccucugugauaagaaagcacugcauaagauaggaagucaauugggauuagaauucaauaugucagcuaacucagaaaucccaguacagaauuuagcacuccuggucaacggguacucuccagggaucuuggccuccagaaaucaauuauuggauuacauccaucuaacccaagaguggguuugaugguggcuguuuuuauuuucuauuacgaagagagugauaauguuuauuuuaugaggauagaugguaaaaacaaucuuuauuucaaaaauaguaucaguucuguugaaugauuuugcguuccacaggauuaauuuucaagauauuugaauugggaaagcugaaaugacuauaaaaagcauguagugccuuaaguuuuuuggaaugaaaugaaaugugcacccauuuaagacuuucauuuaacucagacacuuaaaauaucgagaaaauaaaugacuucucuuggcuaauugucuuauguacaauaaaauugaggguaaguauuagguaaaagguaagugguaucauuggauuuccucucuaauuaagaagagauccagugacaguuuguuuucauggggcacuuuagaaauugugauugugcugguuucucauuuaacuuuacaauaauuuauuaugacaaguaacagaaaguagauaacagaguuuaagugguuuauacuuucauacuucuauguuguguuccugucuuacagacuuuuauaguauugaauaaagggaaggccaucuuccgguucagugccaccucugcccuguacauuuuaacucccuucaauccucuuaggaaaauagcuauuaagauuuugguacauucauauccuuuuucaagugauuaauauuaacuauuuguacaugaucuguaagcacuuuauagcuaaauaucaaauuaaguugggaaauguccauauuauauaguuuucaucacucucauuuugcaucuuugucauauuagccucauucuuaaaguucauuaaucacauagacauuacugaaacauguacucuuuaacauuuuauauauuauauauaaacauguauuuauguacuuuuguuaucuuucuaaaaacacuuauauguauugaauccuacaaaucuaaaguaagauaaccauguuuaccucuaccaucuuuauacaaaguuugugaugguguagaauuuucagugagcaaugauaugauaacagaaaaaucuacuuccagacucaaguuuauccauaguuaugauauaaaacacuucaguguaucuuagaauaaaccuuuaaguauauuuucugucagagaaugucaggagucuuuggccaguacuuaguuaauucuugaaauuuccugaugauuuuugugaaggaaguacuggaauauuggcugaauuucaaauucaagucaugaguuaugaugcugccaugcaaaacuguuugcuuaguaaagacuccggaaguuaaugagagaaguuggcauauauuuccaaauggucuuaagggauuugguuucaugauucccauugguguuaaaaaggacuccacgacuaaauucauuuguuaaucaauuuaggaaaacaauucacuucugauuguaucuuguuugauagcuuugacaauaauagauauuaaaauaccauuauaauuaucauaagcucauacuuuuuuuuaaaggauucuaaaauuugaacggccauucuaauuuuaauaugacagcaagaaauuucuuuagugguauaaauaugcuauuacuaaaauuaaaagauuugaaacauaaaaaucauaugauaggguuuuuauacuuagggaaguuuccuugucccaguuuguauuccuagcgccaucauguggucauuugaugaaaacuuucuuuuucaauuauggaaaauuuuuguuuuggcaguaaacuauaguggaaagaauauuggaucuuaauguaggaaacuuauauucuaguccuggacccuuuaucugauuccucuagagcuuaguaaggccuuauuucccugauuuuuaaaauauagugauaaacuaauuuuuagggucccuuucaguuuuauaauucuguuaugucuguucauuuguuuuagcuaccacuuagaguauauuuacuuacguaccgugacuguuccaagcauuuccaauacauuaacucauuuaaucugcauguagaaaugguuacauuacaaaaugaguacauuauuagcuccauuguagagaaguaggaagagauacaaggcaauggcacagagagguugagucucuuggccaacaucacuuugcuauguugaauuuuaauuacauucccaucauguuaagugucaaccuucaagaauauucacuuuuaauguuaucgaauccugcugcacuuguauaaacucagucaaaauagagcaacccaacaauuagcaucgugcuguacuuugacuacaaauuguuuucaugcguugaacuguguuggauaagauguguuuaagaaauuacaauauugcagauaaguggccuuccucaacaauuuacuaguuuauucaccugaaugagcucaagucaauacuuucugcugaaaaacugugcaacuccagguagcacaaaaauagucuucccacugaaguucucugggaggugaauauauugauuuaauaauaguuguaaaaacaacaccuuauacugauauaaugcuuucauauacauuaccucauuuaaucuauacaaauacucagugaaggugauauuauuacccacauuuuacacaugaagaaauugaaauguaaggagauuagaagacuugcccacaaugcauuuaucccugaauuuuggcuaagcugcaguuugggcuuuucaauguuagcuuuuuguaauauaacacuuggauuuugauuuucuuuuguguguuccuuaacaauaaccuacauuauucagcaugcuaauuaugugcacuauuuugacaaacuguguguuuaugacaaugaguaacccuccugauuggacaaagaauguagaguaaguucaacuuauauuuuuaauaacauauauacauuugggauuuugaaacugugucuuaauguagucuuaaaauaaaacugaagagcauuuuauuaaagucauuccuagacaaaauuacgcagcaagaggacaaugcucauuggcccucaggccugcuggcguuauacugauuaucacucucuuuugccuguaccugguguucaccugaagaccaccacucuuggacauuuaccccuuuuucuuuaaaaucuacaguagccaaaccaaauguggucaaagcaauugcagaaaagagccaauaugguagacauugguuccaguuaaauuccagauaaauacauugaaucaagaaucaaaaaggguuaguuacaaaugccaugugaagacaacauugaaccucgcaaaguuuucauuuccaucaggcacauucacuucaugucaggccaauauaguuccaagcguggucaccaacaaauugaaaaauaauccaaaguuucaggguuguagaacuugaaaauucaguagacugaagacuaaacuaacagaaguggaacuuuuuguagagcuuucagaaaccagaagcauuacuaacuauauugaugaucucucuguucuggggauaccuucgaagcacagaggccagauuugugauaacugaaguugggcuacucuaaccauagcugcucaccugcccacacuuccuauuuguaaugccuguuacuauacagcugcugacccauagcaacuacagaaguauuagguugguguaaacauaauugugguuuuugccauuaccuucaauugaagcuaauguuugcaccaaccuauuuccaagaguguccaccaacauuugcaccaaccuauuuccaagagugucuccuuuccuagacacuuccaggcugaaaccaauaagaaacaugacaucuugaagaaaauaauaaauuuuauauacaaaaaaauucuaaaguauugaagcuaauaugggaggccccacagguuuucagucgcccuaguuuucuugugauuuuaugccacucucacaccccaauuucugaguagaagauuuaaacuuuggaaacaccuaaguuucugaauuaucagaagaauuuuauucuaaauuaaauuuuuacuucuuauaacccuagaaguauuuacuuugauuuuaaagaaguccuuguuccaagcaaguuaaauuaucuuguagaaaaaaaaaaacacgugcuaauuugucaguuuccucucauucuuagaacacuauuaaacuugagauuuuuuucccuaaaagaaaaucauuucaugcuucugcaauauuauugauuggcuauuccaucauguaaacauacuaaauauuucucaggagacuauauuuacauaaauaccaagacauuucagacaauggcuaaauagauuucauauaccuuguauuucucacacuacucuuaagacacuuuacgaaacaacucuuuguguuaggaagcugaauuuaaauuuagggcuacguuucauuuguaugaaauuaaaauccaucugcuuaguuuucuuuuuuaguauuuaucuauuccacugauggagugauaagaaauugguaugcuaugaaaaaacacuguuacuuuaucaaauuuuuuggaugcuuguuuucagauacaccuucacaggaauauauacuuuugaaucacuuauaaaaauuauugcaaggggauucuguuuagaagauuuuacuuuccuucgggauccauggaacuggcucgauuucacugucauuacauuugcguaagugccuuuuuugaaacuuuaagagagaacauaguuugguuuuccaucagugcuuaugcuuuuaagaauagguuugcuuuaccuguagaauauuuuggugugauuuauacauucaaacucuggauuucaauuuagcacaacaaaggucuaaguggaauuucacuauagcaugaaggcuuugcaguaguugaaaacuacaauuuucacacguagcaucagucagaaaauuucacauaugccacucuuccacacacacaugcacaaacacacacacauaugaacacacacaaucuaaugucaaaacacaagcauauuuguaauacaucugugaaaauaacuuuaaaaauuacagccacaaaacaguucuauuggcuacacaaauuugcaaugaccuugcugauauuacacacagcuucuuuuauugguuugguaaaauaauugaaaguaaguaucuacuagcaucaaaacgaucugacaaaucaaacuaagagaagaaagaagauacuugaaauauuauguuuuuaauauauuaaauuacugauuucuaagaccuguagaggaauacauucucucugccucuuucuguuucucuccugaccccuuuucuuucuucuuuucuucuuuccuuuuauggcucucuucaucucuuuagucugaacauaaacuuccuuauccuuaucuccuauucauauccacucaguaauaugcacaguuuaugcaccccaaugcuuuuuuuucuaguggcaaacuuccucaggaagagacccagaaaaauaauagaaaaccauuccagacuaagugaaaguagaguguagaaggaggcagcccaacaacacuuacccucauccuuccuucaggagcugauuuuuuggccucuaacaguugugauguaguggauaggagcaggagagguggcacugauacacucaggacuccgaaugucuggucuuaauuuccuaucugaucaggaugagccaauucuuugcuaggcucucuggucacagcucaaaagaaggccuacaggacuucuauuucuuaagaacaaaauggcaguaacaauaggcgcagcauuggacccucaucaaguauuguucuuaauuugcuuaacuuuuauuuaaaaguuacacuaggaaaaucuuaucucauauauaaaagcaguaaggcaaacugccuuuucaugccuaaauuucuguugggugauuucauauauuuuuuucuaacuaaaacccuaaaccauagccaagauuuacuuucuuuuuacaaguuacacaugauguugguugcauugcuuuccagagugacaacaagggugucuacuuuaugaaguuuacauuuagcuaauggccuuaaauuaugugaacaaagauuaaugauggaaucuaauuccugauuuaccacuuauaauauuuaucauuuaaaaucaccaagaaggucuuuauaaaagacccaugcaaguaauauaaauccugcuaaaaucuugaauaauucugauuuaauucuacagguuuguaacagaauuuguaaaccuaggcaauuuuucagcucuucgcacuuucagagucuugagagcuuugaaaacuauuucgguaauuccagguaagaagugauuagaguaaaggauaggcucuuuguaccuacagcuuuuucuuuguguccuguuuuuguguuugugugugaacucccuauuacagguacgucacagaguuuguggaccugggcaaugucucggcauugagaacauucagaguucuccgagcauugaagacgauuucagucauuccaggugagagcaagguuagauaaugagacggacccaucaugugauucagcauccuucucugcuugacauucaguuuuacagaaaaucaggaaucauaagacuagguguuucaaagaaaaugauucuuauuguuuagacauaagcuuuaucagccuuggaguuuaacaaugucuuaugugagauacuguaauuugaggucaaggugaccugcacuuacaaauaucauggguuuuuuuuuuuuucaccauguuaguuuuaucgagaauuugcucccuuuuaaauguaccaaucuguaauuucuuauucauuagagucauuaaugacuauguguauacaaugcaaaucuucuaaguuuuuugcuaacaaaagagaagggaauaagacaauaaagaauagugugagucugcauggaggauuuauuaucuuaaggcacaauuauacugcagaccauuuucgguuguacagcaaaaucuuuccuacuuauaaauaggaauuuuaaaauauuuauucagguauuuuguuauaaaacugaccucugacccuaaugaaaauaugagacaaguuucaguagcaaaaaggaaaaagacaaggcccuuuccuuaauauaggcuccaugaagaacaugaaccuuccauuacucuaucucgacauaaugggauaugaaucuucauuucauuguuuaaaucauuacauuucuggaguuuaucuucauaaguucuuccccuucaaugaaguguugcuucuccacuagcguugcaaacauucuuggauuuaugaaugaaaucuauguuuucaagaaaauugugugaagcuuuuauuauuucacacguguuaagucuucauaguaauagacuucuuucuuucaggccugaaaaccauugugggagcccugauccagucugugaagaagcucucagauguaaugauccugacuguguucugucugagcguauuugcucuaauugggcugcagcuguucaugggcaaccugaggaauaaauguauacaauggccucccaccaaugcuuccuuggaggaacauaguauagaaaagaauauaacugugaauuauaaugguacacuuauaaaugaaacugucuuugaguuugacuggaagucauauauucaagauucaaguaagaauuauuguuauguacauuuccuuaaaaaguagaauuggauuguuuguaacacaaaggauaaauacuugaggggcuggauaucccauuuuacaugaugugauuagcacacauugcaggccuguaucaaaacaucucauguaccccauauauagaaacaccuaccauguacccacaaaaauuaaaauuuaaaauuuaaaacuaaugaaauaaauaaaacacccucuaaaaaagaauuacuaucauguauauuuggucuuuucauugcuaaugugccuuccaucuaggaaugaaaaauauuuuuaaaugauuacauaacaagacgugaucuuuuagaaaauuaccuaaucaaacuauuuaacaauauuuaaaauuauauuuuauuugguauuucuacccccuggauuuuaaauaauagauuauuuauauuucuggaacuaaaagaagaauuuuguuaaucaccuuaucaauggcuuccacauacauuuaacaacuuuguucauaacuacucuaguuuugacuccuaaaugccacuuucuauuuuaucaucauuuggaaggcugaagaauucagcuagaaagaauuuuccuaggauccuugguugcuauacauucuuccuguggugauugauauaaugaaaggagauaaaauaugugaaugcccuuugcgaauucuacaauacuaugcaaauguaacucauuauacauuaauuacacaaugucuuuaauguaucagaaacuguauaguacacuggggaaaauaauggagguaaugcauggcuucagaguguuauaguuuaauagauuauuuuauuaccuuaaggaaauaaagugauaccuaaaaguaaaucuuauucuuauauuuaaaaaguaguauuacauuaaaaagaagaaaauuacaguuaauaaagcuucaggagacaguaauagaaaauguuaguugggugcaguggcucacaccuauaauccuagcacuuugggaggcugaggcuggaggaucacuugaggccaggaguuugagaccagugugggcaacauagugagaccccuucucuacaaaaaaaaaauauauacacacauauauauauauauauauauauauacuuuuuuuaaugaguugggugugguggcaucuucccaucucagccuccuuaguagcuggugauacgaaugccaguagguccacuucaaucaccagcucccugaaaucuguuguuuguuuguuuuaucuaaguucaaaauacugacuaugaggguuauuuaggguuuauucucucuagggaaaauuuauuggacugcauuuuuccaauacucgaaguaaaauaauaucugaggucauuuucagcucuaaacaucuaugguucuuauuuuaaaccaaaugcaaauauaaauaaaaugguucauuucugaaaauaauagaaaauuaaauuuauuaaaauuaaagguaacuauuauaacugaaaaauuauauuuuccucagguuaaggcugaucauuaagguuagaucauugaauuuaaugggcaaaacuucauuuauaaauaugagauaucaaaaauucauccagaaacuauuauaguccuuucucuuuguuuaauuuuaauugaaaguuaggaaauacuaugucaacuuuccugucuagguucaaggaagucagaauauuagaaauaaaaaugauauuuuuccuuaugugcuucuguguccuguacagaacuauguauggaauaaauuccucagaaaacuuagcaucuagaaaauauaucuucuuacaaaauccaacauugauuguuuaauuccauguuuuucucuuuuugucuuuuauuuacuuauucauucaauaaacuuuacagaaaggcuacccggucucaaacaaacacuaauauagaaauaauuaaugauugggacuuucuaggaggaauauuuguaaauaaauaauuacaauauaguagugucauccuaagaauaauucaaguauauacagguuacugguagcacagugaggggaguucuuaauuaugucaauauuuaguagaaagaaaguugaaaauaccaaggaaaaaguuauagaagaacuggacauugcaagaagccaaggaguuugcaagaaacaggaaucuuugagauaauguaguguucaccuauagucauuauuuuagcuuuaguauuuaagacuuuuuaaaauugcuuucauuucaguuguugauaugauuuaugcauauuuuacuauaaguugccuauauucugcaaaaugugagaauauguuauacuuaauuauuaaaauguauaguguuaaaaauauaggcgagaggaccagaaaauauacuauucuuuuauuuugaaauauguggcuguuuugcaaaaacaaagaaauuccugucauuccugucuauuuuuacugaaugaauuuuuuucgugagaauggugaacaaaugcuaauaccuuuuugaaagauuauguuaguaccugucauuaucacuaacuuuacauucauaaugaagaaauacuuugcacuguaaagugucuaaaguaucuuugcacuguaucuaaucuaaugucauuucuucauaaugaagaaauacuuugcacuguaaaguaucuaauagaauaucuagaauuuagagggagaagagacaaauacuugugccuuugaaugaauaauauauuuaaaauuacucaauaaacuuaaaaguagaaccugaccuuccuguucucauuugaguguuuuuaacaaugcaaauguucaucauacgacuuucuuuuuucaaacaggauaucauuauuuccuggaggguuuuuuagaugcacuacuauguggaaauagcucugaugcaggguaagucaauaauuuguguguaucuguguauauuuguauguacacauacauauguguaucuuuucucucuuuuuauagaaacugaagauaacagccaacuaauuuuauugacauuaauuugcuauauguaagguuuuugauaaaguaugagauuauguaaauauuagguaagauuuauguuuucuaaaacaagaaguaauacuuuuagacacaugcacacguauguucauugcagcacuauucacaauagcaaagacauggaaucaaccuaaauguccaucaaugauaggcuggauaaagaaaaugugguacauauacaucaugggauacuaugcagccauaaaaaauaacuagaucauguccuuugcagggauauggauagaacuggaggcuauuauccuuagcaaacuauugcaggaacagaaaacuaaguaccgcauguccucacuuauaagugggagcuaaaugaugagaacacauggacacauauagggaacaacacacacuagggccuaccagagugugcaaggugggaagagggagaggaucaggaaaaauaacuaguggguacuaggcuuaauaccucagugaugaaauaaucuacacaacaaacccucaugacacacauuuaccuauauaacaaaccuguacauguacguaccccugaacuucaaauaaaaguauaaaaaaagagaaaaauaucuauuaaacaccuacuguauauaacagcaaacauacaaaaagaggaguaauccuguuccuacuuuuuuaggaguauauaauaauaacaauguuguucuuuuagauaaguauauugagcuauaaacucuggagacuccauaguaguaaaaaugaaauggagguguugaaaaugcaaauuaucaacaaaaauuauuuuguaaaauauuauuagaaaugcugcaccauauuuuaaugaugacaccaaguagcuaauaagacuauaugcagucaaaaguugggaaauagauuaguuacuuauuugucaaacuuuuauuuugaaauaccaaaucuuucugacuaggcaauaucauagcauaguaucagaguaaaaaggcagcagaacgacuuguaauacuuucuuuuaccccacuugcagccaauguccagagggauauaugugugugaaagcugguagaaaucccaauuauggcuacacaagcuuugauaccuucaguugggcuuuuuuguccuuguuucgacuaaugacucaggacuucugggaaaaucuuuaucaacuggugagaacuaaagagccacacucuccauuuaaguaaaaguauacaagaaaaccaauugaguuaugaaauuaaaaccggaugauaauauaguagaaagagcagaacuugaaacgagacuugaguuccucuauccuauugauuauaacacauacugagcagagugaugccaaggauugcaauucucucccauuucuucuuggcucaaaaccuguucccuacccuucucagacacagauuguccuaaacagaaggcacauucucccuucagcccuaucuacccccucaaauauuaucccucaggugggaaguaaugaaaaugaaaaagcagauauagaaagauaacuuuggucuguuccuugacuuuccuaaaggcucaggucguuaauggaggacuccauggcauuuuauugacuguuucauucuuggugaauacaaaaauucugccauagaaaucauagugugaaugcauaagcuagaagagaaggaagaagcugaaguuaaagaaacaauaaaaaaaaaguacagggugcuaugaccaacauaauuacuauuuauaucugaguuuugcuagacacaugaguaaauugaaaguugaagccaccacuuagugaaauaauauugagaaauaauucugauauuuuuguuugcagacauuacgugcugcugggaaaacguacaugauauuuuuuguauuggucauuuucuugggcucauucuaccuaauaaauuugauccuggcugugguggccauggccuacgaggaacagaaucaggccaccuuggaagaagcagaacagaaagaggccgaauuucagcagaugauugaacagcuuaaaaagcaacaggaggcagcucagguaaagcugcccugucucauggcacugaccuuuuaucguucugauuguuacguaauauugaagagaaagugaguaccuaagagcaggugguuguaugaggaauuaauaaugauuucuauauuuugaugauccacuuacuuuuauuuaguuuaauuauuuuauuugagauguguauaauaauaaccacaauagaacucucucaugcuauuuuaaucaucuuaagauucucaaaguaaagggaaaauguuauuuugggguauuuucaagugagagacuuuuauucaaugaguagacuggcauuaggaggaaaucaucuuuucuuagaacaagaaauuauugguuaucauaugaagaguugcuccucuaguucuuaaacauagucuccuuuuuucuuuaacuaaaaauauguuggcuuuuaacgugguugcuuuauuaccuuuauaaggaagugaucaaauaauauaaugaucucugauacagcagcauccaauagacauaugaauguuaccaaucuuacacagauugaccaucuaaaaaggauuacuuguuuuuauagugaaguguuaguccucacagugugauaaaucauaaaaugccucuccuaucucucucaucuuucuguuuagcauacaaacuuauugucuuuacuaaagaagaaaguuguuucagaaauauuaauuuauaugcaagaguaauuaauuuaucgagguuacccugggaacaaugauaauaauaaaaaagugucaacuuaguaccaguacaagcuauaaucaaaaagcauuguuuuauuccaugcccaugugccccuuaagaaccaguacugauuugaagaugguggggacaguuuuuggagaacuggaugucuuaucuugcucagcagaaacuauugauucucccuuccccauucuucuggauauuguggaugggugagaaagggauuuuauaacuguccauaaauaggauuaauaauauuuugaggguauuggacaauccaauuucaauaacuagagaaaggaccucagguccuuaucccauuccccugccuuaaacucaucagcuuuucuuccauacucgaguuucuuuuucggagaaaagaaaacaacacuaauuaaauaccaauuuuuaaaguaaaucaaaucccaaaaaguaaugaauuuauuuucuuguugauacauguuggauauuuuugaauacguggucuguggagcauuaacagagacauaauaaauguuaccauggagcaaacuaaauuaucuccaaaagccuucauuagguagaaagaaaaaaaaaaucuccucuuauacuugcagagaaucuucucugugagaugaucuucagucaguucaauauauuuuuuaaaagccaugcaaauacuucagcccuuucaaagaaagauacagucucuucaggugcuauguuaaaaucauuucucuucaauauagcaggcagcaacggcaacugccucagaacauuccagagagcccagugcagcaggcaggcucucagacagcucaucugaagccucuaaguugaguuccaagagugcuaaggaaagaagaaaucggaggaagaaaagaaaacagaaagagcagucugguggggaagagaaagaugaggaugaauuccaaaaaucugaaucugaggacagcaucaggaggaaagguuuucgcuucuccauugaagggaaccgauugacauaugaaaagagguacuccuccccacaccagguauggcacugcugaguuuacugaugcaugguugaaaauuaaaacaugggagagagggggagaauuagaaaauggacucaggaauuuuuaucaacugaaucaaccacuguuguguuauauuuaaacccaucccuucuucacauaguuaugcaaaaacuuuacuccacagauauguaagucuacagcucgguguaguuaagauaacaccaaguugacagucaggagaacuggacugucauucugauacugucugcugauauuugucuauaacuaaugacauuuaaucuuuuugauccucagcacuuuuaagaaaaaaaaaaauguggaacuccggauagucgaucaggaauguccuuagguuauuuuaugauuuuauguuuuuuuucccccuaacuucuuuauaagucaccaugcaugcuucugaaaauauuagucaugguacacuugaucaaaaggcacaugacucugaauuucagaaguaugaacuucaaguuccaacaauacaaugccuuauaggugaaaaagaaauaauaauuaaagugauuuuagaaagguggacuaaaguaaauugugaggaguguugaaaguuuuugaaagacaagauccauaaaaaccaagguggccuuguuaaggucauggugccaguguucacugaauguuuaccacguccauugccauauucuaaggauguuucccuuugaacuugagaaauggucguucaggguguguguguauguguguguguguguguuucaauauguuaagguugcaaucuaucuccucauucuuuaaucccaagggcuagaaacuuucuuuuaucaagguaauuuaauuuaaugugaaugcacauaaaaugagaaugauaaucaaaaggaaugaaccauauucuguuaugaaugcugaaaucuccuucuacauaaucuugcaaaaugaaaucacauucaaauguccauauuaauaugacuuuauuuguuugcucuuucaaacuucuagucuuuguugagcauccguggcucccuauuuucaccaaggcgaaauagcagaacaagccuuuucagcuuuagagggcgagcaaaggaugugggaucugagaacgacuucgcagaugaugagcacagcaccuuugaggauaacgagagccguagagauuccuuguuugugccccgacgacacggagagagacgcaacagcaaccugagucagaccaguaggucaucccggaugcuggcaguguuuccagcgaaugggaagaugcacagcacuguggauugcaauggugugguuuccuugguugguggaccuucaguuccuacaucgccuguuggacagcuucugccagaggugauaauagauaagccagcuacugaugacaauguaaggaaguuuuaaauaguucaggcauggcuggcucacuauugcugcaccagccaguguuucuacagaacggcaaccuugagaaugauuccugguuggucacgcugugaaugcaccugcaucuuguaauaucuuuaauagacuaaccaacuaaaacuuaaaaccuuagcagucuccugcacaaaccugaaugcauuuacuuauuaaaagugcuaaggauugauuagacacaauaauuacugccuccaguuggaggauuugcuauauacccacacugaauuuagauagcaggacauucuccaaggcucugguaugaaaguaaaugaaugauucuauguuuaagugucaaggguauguaauaaaucuuuccaauggauucuucaagaucucugcuuuaguuuagauuuucaaaaacacugcuuaaguagauagcuucauuguuaccuuaauacuccuaguacucauauuuuucuuacuaaaaaaugcugauauaggucuucucaaaauuaaaugaagagacacaaauacauuauuaauacagacagauaaaauaauugucuguguacaaagguauguuauguguuuguggauguauacucagaugaggaauuucuaaacagaugcugccucuucuuagacuguuuacucacuuggaaauauaucagcaugaggaggcaugacuaagucagaauuagaugacuuauugcuuugguacccuggaugaaacuguuguccaugcagcauguguguguucuuuuuaacauagaguuuguguugucaaugaccaucuacaucuuguguccagaaaauaagauggcagcuaaguguguugcaaucauuuauacuuccuuaaaauuaaauagcuaccuucucaaaaaucaagugccuugaucacuuguaggacuuuuaaguuacuaggcuuuuacuauuaguucagaaauaaggguaauaacuguuaaauauaucucuuaagaguuuuaucaacuauauuaaaauuauuuuguauuuuauaaaauuaugaaaucaggaaguuaacaucuugguuuuugcuguaugacuaaaugguuaacaguuugaacauuccaggcuaaugauacaauaagucagaaauaucugccaucaccaauugaauaugaaagugcaugaugcauguguuucaugaaauucacugugucaccauuugguuguuugcuugucauauugcucaaauuaauuguuuaaugcauuagcauuuuuuuuuacagggaacaaccacugaaacugaaaugagaaagagaaggucaaguucuuuccacguuuccauggacuuucuagaagauccuucccaaaggcaacgagcaaugaguauagccagcauucuaacaaauacaguagaagguugguaacaaauucuauuuucguuucaauuauuuucaccaaacuuauauugucucauuucaaacaaauauauuugugaguugggaauagugcauucuaaugaaaagacagucuaauucaagagcuguuauuucuuauaucuacucagauauucuagaagccuuaacaauuuauuuuaaaaugagugauauugggacuaagaauguuuuccuaacuguguagcaacucuuugaaaaugcagaacaaagcauuucuguuagggguuucuaaucucauuagucauagugacccucuuuuuguuccauuaguuuaagacuucagcaguacagcccuuuucagccucauccuaaguacucucaagauuguagaggaagagcaggucauuuucacaaaauaaaaacaagcuaaaaagaugauucuugggucacaucaaucccuauucuagcucucauagucugagguugacaauguagagucauucacauaggguugcacacacaauaucuacaccacccuaaaccauguucccauugagacgucacaugaaagaccacucauuuaacuugaggccaagugcugagccacaaugucagugcauaagacaaaaaacuacccauuguuaccugggcucuaugugugugucugaugaaauauccuugggagguuuagaguaaacuguaauuuuuuuaacaaguacaaaaaagguugucucuguaacaaaaauguguugauuacugaaaauaaguuuaguggauaugaaauaaauguguguguauaaaguauaccuuuuggugguucuuuuuuuuuuuuuucuuaaucuagaacuugaagaauccaggcagaaaugcccacccuguugguauaaauuuuccaacauauucuuaaucugggacuguucuccauauugguuaaaagugaaacauguugucaaccugguugugauggacccauuuguugaccuggccaucaccaucuguauugucuuaaauacucuuuucauggccauggagcacuauccaaugacggaccauuucaauaaugugcuuacaguaggaaacuugguaagcauauuggaagguaaauguguuuagucuucaaauuuucugcuugaaaaacuguuuacauuuaauuguguauagcagucuuucaaccauccuucaugcuuccuggccccugcaaaaucgcaauuauauuuagcuggcuauacucuacuuuuuugccaaaaauaaucacccuuaaugugcucacaaaaacugagaaaggcauaggccuacagcacuacuugaaaagucaacagcaauauuuauaauuuuucaggauccagaaguagcucauagauuaagaacauacuuuuugagauauuauuacaauuucccuuacuguagaagauuaaaauaaaauuguggaucucuuuuauccuucuuagucaucaucacugcaagaaauaauuuaacaacucaaaaaugucuccagcuuuuccucuuccaggaucuaaguaguacauguauuguuuauccaucuauucuauaucaaaaccaugaacuauugaaaacuuccaguacauuuuguguguuauaugauuacaaaggucauuuuuggugaagauugccacuuaauuuuuccuuuuugugcuucaaaaacauaaauuauuaaaguguuugccagucaacucaacuuaggaauacuagcuuuuauuugcugaaggaaagagcuaucuaaaguaauuuaugcauuuccuguaauauuugguuugaaguuuaggauuuuugaugguagaaaacaaaagcaucaugcauaacaaccugcauuuuauuaguuauauuuuugaaguucuacuauuuauacuacagaaguaaauuuauuuuuuucaugugcauaacaaagaaugacaauaguaaugcaccuaguauaauagauaagaauguauaacucugauugagggaaauaggaauaagcuuauagauaaauaaaagugcucaugggcaaaauguugucaguacuugugguauauaaagucuggacaaaaagguaguuugguauaauggaaagagcacuguuaaaaauagaugacuugggcugggcgcaguggcucacgccuguaaucccagcacuuugggaggccgaggcggacggaucacgaggucaggagaucgagaccauccugccuaacauggugaaaccccgucucuacuaaaaauacaaaaaauuaggcgggcgugguggcgggcgccuguagucccagcuacucgggaggcugaggcaggagaauggcgugaacccaggagcuugcagugagccaagauggcaccacuacacuccagccugggcgacagacugacacuccgucucaaaaaaaaaaaaaaaaaaaaaaaaaaaaaaaagaugacuuguacucaaauccuaguuuugccauuuucuugcuguaugauaucaagcaagccauuucacccaucugaagaccucaguuuccuuaucuguaaaguaauaauuguauauuaucuacuucgcguuuccacaaggauaaaauuaaauaauguauaugaaagucuuucaucaacuacaaauugccauacaaauuuaaguuaguaauagaaucauugugggaaaauagcauaagcauuauguucuaagagcaaaucuuaugucauguauguuauuaucugguggaauuagauuaauuuuguuuugaucuuagguuuucacugggaucuuuacagcagaaauguuucugaaaauuauugccauggauccuuacuauuauuuccaagaaggcuggaauaucuuugacgguuuuauugugacgcuuagccugguagaacuuggacucgccaauguggaaggauuaucuguucuccguucauuucgauugguaaaaaaaaaaaaaaaaagcaccaaauucaaaaaccuuucuaacaaucaggguucuugcauagcaaugucauaguuuuuuugccacacaaccauuagcauuguaaguuuuucuguaacauuugcauugucaaaaacuuuuccuacauggaaaaaaauucucaauuauuuaugaaaaccuuuauuucaaagaacauaguuacguaaaaguuaacguauuacucaguugcuauuuucacuaaguauugcuucuagagacuacuacaguuaauauuucuagaccuaagaaaauauuuuuaaugaaaaugcaucaccuuuuaauaguaacuugaaaauauauauagcccuuuguagcaguggaugaaaaucagauguaagaugugcaugcagaaacuuuuucuaauucugucucuggaaaauaugcaucuugcgaaagucaaaggagagaaagucuguaggauuacuaagcaugcccauuaauucacacauauauccuuacaagucaggaaaauaauuguagaauuauaggaaauauuccaaguuuuucaaugcagguggauguaacuacaugaauaccccuaaggagcauuaaugaauaaugaacacuuuacuuauaucagggcucaguaugauguuacuuugcacacuacuggcaaauuaauaucuuucagcagagauauuucagauucagauguuaauauuauaauauccggccuuagaaccaccuuuauaaaacaaauuaagaacaguuggauuccaaguacucauuaaaaauucacuauaagaggccuggcuugguggcucaugccuguaauccuagcacuuugggagacugaggcaguuggaucacuugaggucaggaguucgugaccagccuggccaacauggugaaacuccgucucuacuauauauauauuuaaccaggugugguggcacgugccuguagucccagcuacuugggaggcuggggcaggaggaucacuuuaaccugggaggcagagguugcagugagccgagaucacuccucugcacucccgccugggugacaaaagaaaaaaaaaaagaaaaggaaagaaaaauaauucaccaucagagaaaaugaucuacaugguuaaaauauggaaaauccagcuuuuccuagggaguccaaaaauuagccaugagccugagacgguuagggcagaucagauauuguaagauauugaauucuaaugaccauuucuagguaaagcucaauauauauaaugcuuuuaagaaucauacaaauauauauuaaucuuucauuuuccagcugcgaguuuucaaguuggcaaaaucuuggccaacguuaaauaugcuaauaaagaucaucggcaauuccgugggggcucugggaaauuuaacccucgucuuggccaucaucgucuucauuuuugccguggucggcaugcagcucuuugguaaaagcuacaaagauugugucugcaagaucgccagugauugucaacucccacgcuggcacaugaaugacuucuuccacuccuuccugauuguguuccgcgugcuguguggggaguggauagagaccaugugggacuguauggagguugcuggucaagccaugugccuuacugucuucaugauggucauggugauuggaaaccuagugguauguacccacuuaagauaugcauuuuggaaauacaccagcauggcacauguauacauauguaacuaaccugcacauugugcacauguacccuaaaacuuaaaguauaauaaaaaaaaagaguauaauuuaauggugacuguuuugucaaaaagaaaaacaaacuaugauuauugguuuaaaaguccauuaccuuggauauauuaucacuuuaacaacacagcaauauagcagugccccugcauuuuuuauaccaaauucuauuuugucagucacuuuaucacauuuuuuaugugaauuacaauagaguaucauauugagaugagccuaaaaggaugugcugggaccauuuuauaaauucagagccaaggaagagagaagucuaaaaaaaguagagagaaagugcaaaauuaccauccagacuaggacuaaaaaguggugucuuuaagaguucauaaugcuugugccauuucuuugccccauugcagcauaugauauucaaucacucuaugucauauggcagaugcacuagccaaccugaguucaucaguucucgaauggcuaaugaugccugagauuaccauaauggaguaacugaucaaucuuuaucucucuuaaauuuggaguguuacuguuuauaguauaguaauacauaaaauauucuaaagguauguacauucaugugccagucucauggaaauaugagagauuauucauaaacagcucuacuuagucaacaaugaaguaugagaaauauaauagauuaagaaaacaagugucagccuauguuaagcuccuaaucuucauucugaguuguaaugguuauuuuucaauugacauccaauuuaauaucuuuguuuauugaaaaauuauagaaugcauuuaaaugcauacuuggaaacauuagugauuuuuaagaauucucguauuguacacauauaaaucuguuuucuucuacucauacaauuuuagaguuaacaaaaccuuagauuagcucauucaauuucacuuuacgaaugggagaacuugagagcaacagaaaucaugucuuuguccaaggaugugcuauugagccagucacaaauucagaucacccaucuucuaaucacuaugcugugguguuuccuucucaucaaguuuuagaacuuagaguuuuuuccacacuuaaaagaaagaauaagugauuguaaucugcucuucccuacauugguguaaaauuauaaucauguuuuuguuguuuuuaagguccugaaucucuuucuggccuugcuucugagcucauuuagugcagacaaccuugcagccacugaugaugauaaugaaaugaauaaucuccaaauugcuguggauaggaugcacaaaggaguagcuuaugugaaaagaaaaauauaugaauuuauucaacaguccuucauuaggaaacaaaagauuuuagaugaaauuaaaccacuugaugaucuaaacaacaagaaagacaguuguauguccaaucauacagcagaaauugggaaagaucuugacuaucuuaaagauguaaauggaacuacaagugguauaggaacuggcagcaguguugaaaaauacauuauugaugaaagugauuacaugucauucauaaacaaccccagucuuacugugacuguaccaauugcuguaggagaaucugacuuugaaaauuuaaacacggaagacuuuaguagugaaucggaucuggaagaaagcaaagagguaagauucuauaggugugggaagguaugaauacauauacauauauacauauacacacauacagaugauccucagcuuaaugauguuuugacuuaagauuuuuuuuuuuuuuuacuuuaugauaauacaaaagcaauagccauucacuagaaaccaugcucuaaauuuugaauuuugaucuuuucccaggcuagcaauuugugguacaauauacucucaugcugggcaggggcagcaagcugcagcucccagucaaccacgugauuacaaggauaaacaaccaauauuuaccguacaguguacuguauucaggaaauuaccugaguuauccaacaguuuauuauaaaucaugcuuuccuuuagaugauuuugcccaacuguaggcuaaucuacauuuccugagcauguuuaaaguagacuaggguaagcuauaaaguuugguaguuagguguauuaaguaaguuuugauguacaauauuuucaacucacaaugaguuuaucaggaacuaaccucauuguaaauugaggaacauuuacaauacaugcauuauauugccuguauuuauuauuauauauuuuccauauagauuuuuuugacaucauguaaaauuuuauuucacugaggaacaaaagauuuaacucggaaaugacugauaaauuaaaggguaauauaguauacgugugaguuuucucauccuuaguaauggauauuuguuagaugaaugaaugaacgaucuaacaaauagacaaacaucaucagauuuaauccuuacaauaaccuggaaagaaauguguuauuauguuaacuuuucagauaagaaaauuagcuuagggagcauuaggucacauagcuagugaggggagugccgagaguugaacuuagagcccuuguuuacaaguucuguuuauuguuuuuugcaucacauuggcucauguacauugaagagaacuuaacaacaagaaauauucuuguagcuccuucaacuaaaauuacacugcccuaugcauuagccuguuuggacugccauaacacuauaccauaacuggguggcuuaaacaaccaaaauuuauuuucucauaguccagaaacuggaaaguccaagaucaagauaccagcagcaucaaugucuagugagggcucacuccuuggguugcagacagccaccuccuugcugcguccucacauggccuguccucaaugcauguacauggaaagagagagaacucuggugucuauucuucuucuuauaagugcaccagcccuaucagaauaaaguccaaccuguaugaccucauuuaaccuuuaucaccaccuuacaggcccuauccccaaauacagucauauugaagguuagagcuucagcauaugaauuuuguggagacaaaacuuuaauccauagcaaccuacuuugaaauauuaaguuaaaagucuaauggauauauaagauaauuaacaaggagucuaggacaaagcaccuuuacuucccauuuaguguuuggaaaucucaaaaacagcagggugcccaucuuuuaggcuguauagucuaaauauuuuaaaggauugaauacauuaaagacauuuuauuagagauacaauucuauuagauaucaucauguccauugcauuuugauaguuguccauggaagauaccacagguaugugacauucuuuugauuuagugacuauaucccuuaaaagaugcuucaaguauuuauaaugagucucugaauaaucuaggucagccuccacuuuuaggaguagggggcuaauauuggagcuggaagcagcugcccugacccuagcauuagagcugcuuaguuaauucagauuuguuugaugagagaagggaaagaaauauagugcagagauguaauaguagauagauccugucacauuuccaugucuauggaaauagauucaggacaaaaaaaaaauagacuguuuuuaucaaauauuguggacuuuuuuacagaaauuuuaauuuggauauuaugucaguucagacuuuguuuauuugaguuuuccuaaggaaucagaugaaggcuaauuuuuugaaaaauuguugucuuuauaaaauuguuucugaacuucuguuaaaauaaauuuaguaauagccuagucuagcuuccuuugucuugaaucuuuagaccuacauuuagcauuugaugaggacuaauggcuaccauaugcuaucuguuauauuaaaaaggaaaaagacuauuuuacaaagaccauccauaagauauacauuuucuguaaaaauuugacaugauucuuacucuuauuguuuuuuuauauugaucaaggcuaaaagaaacacuaaccuuuuuauaaagcaacuauccacugaagcacuagagguaguucuguuucuuucuacuuugugguauuuuauaucuuggaacauugcauuaauugaaauuuuaaauguuaagguaauagaaacuuuagagauaauuuaauguggugcuucucaaauugugagucauaguuuaguuagacuugagaaaucccuuuaauaggccaguuuuuuuuuuuaauuuuaaugaaauagugauccgcccaccucagccucccaaagugcugggauuacaggugugagcuacugcacccggccaaugaaauagaacagaauaacguuagagcacauuucaugucagagggagaaguccugguaaaugaagcuuuugccaccugugcugaacuuuaauguuuuguuugucuaauuagaaugcaaccacuugguucaugggcauagugucugaaguccaggaguucuuaagcuucagaaagacuguuucagcuuuuugaagguagugauaaugaagccuuccuaacccuaggcagaacagauugcuuucuuuuuugguucccagagauauaaggcauagaguauaguaauaaauaaugcaucuucuugacucaugcgucuuacaaaguacuaucauauuuuaggguagcuacuuauaugcaugcaugucucuccuuuuauguggugaccuacuuaaacauguuugguacaaaguagacacucagaucaaacuuuuccagcucauucaacucuucuuaauaaaaccauucugaagggcucucauaaauacuuucucugauuagagcauacuugagauugucauuuuaauuccaauuauuuuggaccaauuuuuucucuagauucaagauucacuugaguuagauuuuguuguuuuuguuuuuguuagccauguuaccuugucacuuuacaccacccuucuaagaaaguaauaaucucucaucuuuuccacaugaauugcuguugaaaugcaguuguaucucauccagacgaaauuuuguaauuaaauacugaaacuucuauuuauccccuaaugauacauuucaauuucuuuuauucauuuuugaaucuggcuuucuuuuuauauucuuucacagauuaccacauuguaucaaauuuccuggcacuuuuacuucacaauuccuuucuucuuggucagaaauaaacccacacaauauuguuugcccucauugcuucaucagucuuauacuguauucuguucaucaaaguaaggcauaaauuaugagauauucugcuuuuagaggaauuaagcugacagcagaugccccaauagaugaagagucuuuguucuacauuaggaaugcugccuguaguauauuaaucucaucauuuugguucuuuuuguuuuagccuuuauucuuuuugccuauuuucauuuauuuaucaguuaucauaugccagggagacuagauaaaggaguauacuaauaagcuauaaggaaugauuuucucucucugucucuguguguguguguguguguguguguguguguguaugacuuucaaccuuuaaguaugaauuuucauauugagacauauguuacugaugcaaaaauguuaccuuucauggccucuauuagacuaguuucauuugaacauguuauuguuuccauuccugaauuccaguaaugacuuaucuacaaugcaucauuauaauaccuccaaaauuauauuaaugccuuguguuaaaauuacaagugcccacuguuuauucuucauacacuaaauauuuguuuuuagacaugugaggccacaguuauaaaguugguaaaugguuauacucuggagccagauacuggguuauauaauuucauuuuagccgcuuacugugugacuuuaccuaucuaauaaucaguuuccucaucucaaaaaugugcauaauguuacugacugcauuucugggacagaguauuaaaugagauaauaaaugugaaguacuuagcacagugccuaauuaauauagaauaucugguaaaucaucauuauuauuguuaccaguugcauuccacacuguuccaguaaguuuucuuacaagaauuacuacugguaacauacuccacuauuugucuuuuuuuguuguuugccuuuugcccucuguaauaaauuguuuuauaaguuuaucuggggauggugauacauuuuauauuuucuguuuauuuuuaaauuguuuugauuacauucuugauaugguaagcuccuuaaaauauuuaagaaaauuacuuuucuaaggggcauuccaaucaggaaauacaaacaugcagaaaccuaaagacaggaagcaagaggauguauuuggagacaauuaguaguuuggaauuccgggggcguaaaucacaggagcugaggaugagauguagguaaagagucuugguuuccaggaagcaagaauagacugguaugaagagauguggugaacuggaaccucauauuuauuuugccucuuacaucuguggugaacucacaccuaacuauccuccauuccagagcaaacuaagggcuguuuuuucuacaccuuccuccuauuggucuccaaaagaagaaagggaauagcaugagucacauuucauccucucuuuaaguccuaagagacuucaaccuucaaaguacauucaaguaauuugaggaauuguuuuuuaaaaccucagaaaauuucuugacucaugccauaguaggaauaaugauaagcuagaaacaugaauuuuuauugaacauuaauaauaaagaauggugacuuggacagaucugagagagcuuugaaggcugggcaaaacugccaagacuaugcaaaagacaauauaaaaucuuaucuccccaaauagaaaguaaauuuauuuugguuuuggauaguauuuuauaacauuucuauccuccgaagcaccuaccacaaugcugggugcauaacaguugcccaauaauuuuuugagguuugguugauuuauauggauacuagauuaagagcuuauaagccuuaacucuacuaugagcaaaucgcuaaaucuauauuaccccguuuccuaauuuauuaaaugagauaucuguccuaugaugcuuauagaaauguuaugaagaucuaaaagcuauuuggaaguuaaaaauguucaaaaguguaaggugaugucaagaaaauuacuacuuaauuccauuuaaauaaaaauuuuaaauaaauugaguuauuaaaguuguaccuuuugggaacaaaaaaggcacauuacuaaaguaauuauaaaagaaauacauuuguuuuugcgaugagugagcucuagaauaaugaguaaaaaugugagguccuuaguaauucagguuauguuaauaacagcuauuguuuaaauguucaccauggacaaaguacuauuggagggcauauauugucccauucagucuuuaugccguaagacacacuguuauuccagccuuaagaugagaaaaauaaacauauuuugaacaaaggaaaacuugccaaaguuacacaaacaguaagugguugguccuggcagucugcuccauagucugcuccagagucacgcucuuaaccgcuacacuaaaucuuaauagugucugaaaauguacuuucuuuggcauaguucugaaauaaauaauacuauuuguugaagaacuagguacaggugucaacuauagauuugguguuaacuuccaaucacugcacauugggcauagguuaacagcauagucuggaguguuucagaguccuccugcuuaguccugaaagguccuguuccucugguacuggccugcacuuuaggcugaucugcuucugcaucccacacugaccugugguggucuaauucuacuuagagagcacuuagucucccagagugugauaguugugcuuaaggagcauccccuucugaguuuaaagcugcuggaagagucuuccaaaucauuaggaagaacuucuaugauguaucauuagcuuaugaggucuuugagaacaggaaaaacacuaacccugucuucccuuaaguccacagcacauacaacauauuuauuaaaugaaugaauaaauaggugaugggcaguuacuucuagauuuccauuuuuucccaauuauaucacugauauauaugcauuuuaaaucuacuuguugcuuugcugauauuuuuccaucuaauacuuuuaucuuacguuauauggguuaaggaacauacgacaaucuccaaccuaagcacauagucucuaagagauggcaacuacucucugcgaagaguacuauccauggaacccaagaguacuaucuccacuacuucuaauugaucacuagggacugccaaagcuaccuaucuuuguccaccucucugcauucccaaggccuuuacccagugucagaccuccaucaucuuccaguuuuacugcuacagccuccaaacgggucuccucucgcuaguguagucuugacaaaacaauagguggucuuucuaaaaugcaaaucccguaaccguucuguccucccuaaccuuucaggaguugcccauugcucacaguauggagucuauacuacuuaacauggguacaagucccugcaaaacugaccaccgcugacuccuucaguaucauggaauaguacaccucacaccuccccacccagcuauacuaaucuuucauucaauguaauucccuaugcuuuaucaguucucaucguuauaccuuuucucucugacaggaauacucucuuacucuauccugcuucaccugacucauccucacccaccacauccuucuugucccaaaugucacuuuauucuacccuguccuuccuagauugagcuaggugguguucucaauauacucuauacuacuccuauuagaguguguggcaauugcuucucuguauccuccaucugauugugaaccgacgagggcagauacuaagucuauuauguucacuauuuuauuuuucaaguccuaguuuugaugccuggcacauuuuugguagugaaaaaguucaaauaucaauaauuacaccuauuacaaacaauacaauacugugauggaaauuguuaccauuuaucaaauaagcauacgccaaacguuauucauguguuaucuuguucaguccuuauaacaaggaugugaaguaagaaccauuuuacaaauuagaaaccuaaagccuaaggaggucagaauaauugguuaaaguccauaaaaccagugauugugauucaaacucaaguuucucugauccucugaacaguaguacuuucaacucuuucauuauauagauauacaguuuauuugcccaguagacacuuauuaaguauguuauaauuuaacauuaaaaaucaaugucaaaauaacauuauagaagcucugugcucaauuuggcaaaaugaauuuaacaaugaaaauuacucauuugauuugcauuuugguuucuagcuuggggauuauaaaugcaauuuuucagaauuuuuuuguuuucuuuccaauuuuuuuguauuaccaugauuuucuauugacucaauaugucugaaauauguugcuuuuguucccuuauauuuaauuauugauacagaaguuuaugugugaccuaucgaaagcaaaauucagaguaguauauuagagccguauuccuccacguucacuuuuauacugggcaaguguuugacuaaagaauagaaacaacugacauucuguaaauaugaauaaucacugaagauuguccuuucaacauacagcuugaugaagaaaucaacugggaauaaugugggaauuaaugaguuaauauuugaguuuucuagcugcccuguggaaauguugagucucauuacagugucuuuuccauugauauuauauuuuccuuuguugagagucuuuaauaggggucauuuuaauuuuuaauaugcauaguguacaauagaaauauuuacuagugcacaauguacacaaugaaauauuaauacuagcauuucugagguuguagagaaccucauuuuagcaugacuuaggagauauaugugucacaauaguaaaguacccagcauuaaaauaguaccuguccagcuuuaaaaauaaguacuuuggauaauauucuuuauauguuaaauauauacauguguauguuaaauauauauauuaaauauauauguacacacauauauacauauacaaauauauagacaucgcaugaccacauauuaaguaugcuuuugacccuuaaauuccagauuuauuuauauuacuuauuauaauuugaacuccuacuaaacucuauaaauaagcuccuuauaacaaaccaaguuuaaaaauaaaaauauaaacauuguaggaucaagucagagaacaagaaaaaaagcauuuaaucacuuacucucagagaauauugaagaaaguuuucuuugccuugcuuuguuuugccuuacccucaaggucaaaaucauuugcuauaguaaagagcauuguuaaaaaacaagaaauuugcauaaauccacugcggaggaaaacugcucuuaccaucaggguuguaguuauuaagugguuauugaaugcccugguguacaaggcaaaguggaugcuucauauacaacguggucucugcauucugucagcucacauauuaagucagccugccaaaaauacauggaugauacaagucaguguauaaguguauaauuuagcuauuaagauucaugugugaaaauauacauauucuuaaauaaacuagccuauuuagaaauugguaaaauuuaagguugauucaugguuuaauaaacauuaaaauagauuuuaagaaauauuccgggaggccgaggcgggcgaaucacgaggucaggagaucgagaccacccuggcuaacacggugaaaccccaucucuacuaaaaauacaaaaaauuagccgggugcaguggugggcaccuguagucccagcuacuugggaggcugagacaggagaaugacaugaaccugggaggcggagcuugcagugagccgagaucacgccacugcacuccagccugagcgacagagcaagacucagucucaaaaaaaaaaaaaaaaaaaaaagaaagaaagaaagagaaauauuccauuaaucucuaaaacagugagaacaaauuacuuuauuagugaauagcaaauuucaaaaugaaauuaaauuucaaucuaagaacaaaaaaggaaaaauuaauuggccuuacugauuuuuaaaucuguaaaaauacuuauuugagaauauuuuaguuuugccguuauugaauuucuuuagaauuuuauaugaauucguauuucaugugcuaacauagagguggacuuuuccuacacaucugaagaggagcuuuuccuucccuuuuugaguauuuaauaauaauaguguuauuaucccaaucaaauaaagaauuggaccacuucaucuuuuaucucaaccguuauaagaauauauugaugcaaauauacugguuaugaagguuuuaauacaacuuuuuuagccuaugguaaaauauuuuaaaaaauagaugacaacauuuagauuuuggauaauauuaauagcaaaaguaaauaugacuguauauuaucucaaaaaacauauuuacagaaaauuuuuauuuucaaggguucauggaauauuucuauaaaaguaaccauauacuggaguucaaaguaaagcucaauaaauuuaaaauagcuggcauauaggguuauccagucacaauguaguuaagccugaaauuaauaauaaauugauagaaagaauuccaaccauuugaaaauuaagaaauugccuccuaaacaaauauugaauaaaagcauaauaaaauaccaaaauagcuauuucaaaaauaaaagcauuuuaugucaaaauuuguggaagaagaccaaguagucauuaauaugacuuaauauuacuaauaugauuaagaagggaugaaagaaccuaacaaauaucuuugagaaauuagaaaaggaacaaaaaaggaagaagauauacauaaagagaaaaaauagugaauuaucaauguagcagacaauauugguauaacagguuaugguucuuaggaaaaaaaaaucaguaagacacacaaacuuugguguaucaggcagaauucuaagaugaucucaaugacacuugcccuuguauaauccccacuccaugagugugguuggaaccuguggauaugguaucacccuuuaauuacauuacauuuaugacaaaaagggggaugaugcugggugggccugaccuaaucaggcaaacucuuuaaaugcacagugauuucuccugcuaucacauagaggaagcugaaaagauaugcucugccuggccuagaaaaaagcaaacacccauauuguaaauugcauacagcagccauguggccagagacuauggguggccucuaguugcugagagugguucugggccaugagcuggcaggaaaguaggaagcccagucuuauaauuaugagaaaugaacucugccaacgacaguaaacuuggaagaagauccugagcccuggaaaagaacuggauuuccagccaacaccuugacaucaucucaaugagacccugagcagagaauccaacuaggcagugccagacuuccgaccuacagaaacugugaguuggugaauguauguuaagaugcuggguguaugcucauuuguuacacagacacagaaaacaaauacauuuggcaaauaauccuuguuaggaaaacucaaaugauuuucuauguguaaagagcaauugcaaucaaauaagaacacuaauacuccaauagaaaaauaggcaaaagaccaagcaccguggcucacuccuguagucacagcacuuugggaggccaaggugggugaauugcuugagcuccggaguucaagaccagccugaggaucagaugcugucucuacaaaaaauacaaaaauuagccgggugugguggcaugcaccuguagucccaguuacuugggaggcugaggcagaauugcuugaaccugggagguagaggcugcagugagcugugacuucaucacugcacuccagccugggugacagaaugagaccugucucaaauaaacaaacaaauaauagucaaaagagacaagucauaaaaaauauaacuggaagacaaaccuuaagaaauauuacuccuaauuguuaucaaauaaguuaauaucaaaacaaugguaguguaauuucugcuuuucaauuuggccaauaaaaaagaagaaacaaaagcaaaacaugaaaaggaaaacaaaacaaaaacccagguaaauaaugcauuaugcugaugaaggagauccaugagacagauacuuaacacaaaucucagaacaugguaucuuucaauaaauguugaguaauugaauauuucauauacagcuaauagugaaauuaaaagcccagcuacauguggaugguuucuuugucucuaaggugggaauagcuauuugcuucuccuuggucagagaugaucacaggauuuuucauuuauuuauuuguuuguuuguuuguuuguuuuuugagacagggccucacucggucauccacgccagagugcaguggcgcaaccacagcucacugcagccucaaccuccugggcucaagccguccucccaccucagccuccaaaguagcaugcaccaccacauccagcuauuuaaaaaaauuuuuggccaggcgcggugucucacacuguaaucccagcacuuugggaggcugagguagguggaucaccugaggucaggaguucaagaccagccuggccaacauggugaaacccugucucuacuaaaaauauaaauaauuagccaggcaugguggcaggugccuguaaucccagcuacuugggaggcugaggcaggggaaucgcuugagcccgggaggcagaggucacagugagccgagauugcgccauugcacuccagccugggcaacaagagcgaaacuccguaucaaaaaaaaaaacaucauuuuuuuuucuuuuuuuuaguagggacagcaggaucucacuauguugaccagacugaucacaggacuuuuuuagccacagucccaacauguuacccagacugugcaggcccagcagccauacccacucugaacuuccucauccuuuucuccuccugaguccagaucugcucccucaucaccuucucaucaguccucacuucauaucucucuuggauuuaagacuguccaaauguaucauuucaaauucucaaacacuacaaagucauagaaaauuaaagcuggaacuuuaaagaucaucucuucauuuuacauauuuaaaaaaugggcuaaaggaagaauuauuugagcaaagccacgcagaaaguaagaggucaaaccaggucuggguuucuuuccaguuuauuguugguggcuuucuuuccacuacuguggccugggccaggagaagggugaaaaaauaagguuguuggcuccacuggaggccauaacuuguuuuaaaaguucuuggaauagucaauucagaaauggugagugacagaugugguuuggcuguauaaaguaauuuacaucaucuacuuacuccauauauggaucauuuuaccacaugauaauguauacacauauucugcauauaugcaaauaaaaugaccaauaugcauacuuauuguaaugagguauagcuauaaaauauucauagaggcaccauguugaauuuaaaaagagcuuuaaaguugagaauuuugcauccuaguuuguuuuuuuuuaaccuauugugugcuuuuugccaaaucaauuauacuauccaggucuacuuuaccaaucugaauauugcaguuuucugaggucauguucaauuccaacuccucucagcuucuaguaaaaaaccugaguauaauuugucaaguuuaccugauugguaguauauguuuucacguagcaaagcuuucacauuuugcugcuucuguaagccugguuguugguacuuaacauuaaaaagucagaacuacuaauuauuuauuucuugaagaaaaaagaaaacauuguaacuuuucuaaaaugauucggugugacaugaucaccagagugacaucccauuacuuuugccacauuguauugguuagaagcaagucacagguccugcccauacauaagggcaggggauuauacaagggcaugacaacaguggccagaaauuuuggagaccaucuuagaauucugcuuacuacagacugucaugaagaaagcauguuugcagacauaaagaagagauucuuacaugucauucaacauacugucaauucuucaaguuuauagauuaaaccccugaaauaacuuuuuuaauacccacaaagauacugucucuucacuugguauuaccccgccccccaccuaguuacuagugguguuggugacaaauucuaaacuuuaagagccuuuuuaaaauaauagcucuuugcauuagcuuagugccaaguuguuucaucugaaauugcuaaaucuugaagauuuuuuucauuuuaucaccuuuuuuccacugaaauucaugauacuaaauuccacauaauuuccccuauauucaccacacauauuuuuucuuucauuuaacaucaucuucuuaaauuugggcaugcauuuccccaaauuuugauucaauuaugguuuuccaauacauuuucaaaauuuuuuaaauuuucauuuauguauuuauuuauuuuagaaaugggauccagcuauaaugcugaaauuguucccaaacuuauaaguucaagcaauucuccugccucagcuucucaaguagcugggacuauagggaguuuuccaaucuuuuaaauaauauuuuaaucaaauuuuuucauguaucaugcauaaauuagaugaaaguggaacuucccugcuugaauuaaagccuucagccacuuaaggcuggagugagaucucuggagaacauuggcuggaaacaccucuucugucauauuaguaggacagaugccuuucauugcaacauacauacugaauguugguauaauuguugauugaaauuuagcuguacaacuuaugaucugcagaugauagacuuucucuaaguucuaaaguacauuaaagacuaagcauauagcauuuuagaaauaauuuauacaaauuauguguuuaagcuuaaugccuuucuuguuuuuauaaacuuacuaucaucuuugagaaggucugggugacuuuuauauuaauguuuuuauuuauuuuaaucuauugacuauguaaaagguuuacuauuuguuuaauuuaauuuuaauuucuguauuguauuccuuauuuaacaugccaaucaaaacucuuguuguuccccauguuuuggcuaaaaacaguuuaguucggucacuugugaacuuauuuuauuuuguuuguuuuucuuuccuuucuuacacuaaugcucauuuauuuacauuauauauaaauuucuagaaaaagcacuaacacuucucucagguuaucauaguuuaucuagaguaauucauugacauaagccccacugcuuaugguuuaaucuuucuaauagucacaugucacuuuuucugauguuauuaugauuugaaaguaggggaaaauucuucuuacuauuaugagaaucagggucuaucauaaggguuagccaugauguggcuuaccagccucccuuugcaaaaugcugacuugcgaaguagagcuuaagccaaauaugaauaccauuuuuuaaaucuaauuuuuaaucauauauuguuccugaaagauguauacacuucucuggaucccaaacauucaacugcuccauuuauuuacaaaauaaaaaugacauguauaaaaaugucacuuuaggugccuuguuccagcauggguucauuguuuggagugcuacaucaauguuuuagcaugagcugcacuuguaauucaucaucuauuauuucuguuuaguuuuuuuuuucccccagaggacaaauaucuuaacgaaucauauaaagcaaccugaauuuaguaucuucucagaaauuuauauuuguaacuauuuaaaaaguaaauauucacaccuaauuuuaugguuuuuuaauguacauguaucuaugugggggauuuaccgguguuacguuuauucaaugauuuugacuuaguuuuuauaaauacaacaacacuuuuuaaaugcauuuuucaaauucuacaagauuaaauuacacacuuacaguauuuuagaauaguguaaauugauuugaaaauaaacauaacuuauucuugauaagcauaccauucagcuggugaaaauagaaaugugcagauauccuaggcaguagccaacgaccugagcaauuuuugcacaucaaggucaucaguuauuguauuuuacugagaaaacugcaagugucauuaauuuuguaaguaaguccauuagaaugaagagaaguuauaauaaaauauaugcccaaaguagucccuguaaaguguugaaagggguuuaaauaagagagcaauuauuacucuuccgcaaugaugggaggaaaaaucacuaggagaaaaagucagagaacauuaagaaguucaccuugggccgggcgugguggaucacgccuguaaucccagcacuuugggaggccgagacggguggaucacaagaucaggagaucgagacccuccuggcuaacauggugaaacccugucucuacuaaaaauacaaaaaauuagccgggcaugguggcgggcgccuguagucccagcuacuugggaggcugaggcaggagaauggcaugagccugggaggcggagcuugcagugagccgagaucgcgccacugcacuccagcguggacgacagagcgagacucugucucaaaaaaaaaaaaaaaagaaguucaccuugauuaacauacagcuucuaucugugaaagacaaauuugggagauuugguuggaacucuaaguugaaaacaaaaacuucauccaucacuaauaucugaaacagagguauucaucuauucauucauucaccaaauguuuguuagucauucaccauacauacacuaagcuuuguggaccacaaaggucuaagucacaugaggcuagaaugaggauggccauuuuuauuuauaguuaaacaaagaaaagguaacaagaauaaacagaaauuucauaggaauuuggaaucugacugagaaaauaguuauuucagagauaaaauaaggaaaacugacuuuugauuacugccaauguuugaaauaaguaaaaguaaacaaaaaaauuugagucugggugcugaaagagugauauugcagaaucaggaauuugguuaaagaaguauguuuaagauuguuuaaaaagucauuacuuagauugagagcauacuaaauuugaguauuauuaggcacaccuccacuuuccuacaguaguucagacagacuguagaauauacuuauauugcuuaaaaaauguuuuaaaauuaauuuguaaacauguagaagaucacuugucuagaccugcgaacuuuccaagugcagauauuccauuggaaugcuaauaagggcauuugaucaucuuuuaaaucaccuuaaaauuucugaaauauggagugacuccaagcucuaugcauuaaaaaaagaaagcacacuuagaaguauauuguauccauccauugugacuaucuuuggcuuugccauuaauguuuuacaauuuggagaaguaacacuauucaccaauuccuggaucuacagcccacccauggucccaguuuguuuauaaaguaguccucaugaaauagcaaaguuauucagaaacauuuaacauauuuuaaauauaagauaauuuagaguucauauuaucuuguaauguucauacaaucauacaguucauacaaucuuauguuauuaauauccacuacauucuucaagaguuaccaauguaauauggguacuuacaagcgcuugcucauguacuuaaaauuaguaguaaguuuuacuuuccuaacauuuaguagacaggguagaguucguguauguccaauugcaugccaacucuuauauuguucaauuuuccauuuugauguuauucucauauuguguuacaucaucauuacacuaucuugguugaguaacucaaagggauaaaauaggaauggaaaucauauaaacuuaaaacucagguuuuuuugugaauugagacucuaaugaaaaaacaucagaagaaccauaaaucuacauguauuuuuaaaaaguaauucuguaagagugaccaucuuagguaagcauccuaaaaauaaaugucuaaauaagaaauauaagaugaauaucugaauauuaaaacuuauugaacuguugaucuauuugucuucuucagagaaugccauuuugaaaaugugucaaaaaguaacauaaggucuuuuggguucucguaauuuucacagaaaauagucacaacuuagguaagucagauaagucuuugucuuagaaaaaguaaaaaacaaugcuuuaauucauaaagugaauaagugguuucacuuaaaggcagaauaaaaaucaaugcuucagagguaucauuaaaaguaguauuccucauaagaaaacaaauaugguuggcaaaaaagcaaaacuaguuauuggcaauacuuuauuaucaguguaucaguauacuuuaauaucaugcaauaacaauugcaugauauuacuaguaaucaaggaagaacaauuuuuauguacauguucaugccaggaucuaauucaccuuacaauuggauaaaacacuuaugugcaaagaaucaaucauuuaucuguggcacuuacaugaagauuaauuacugagcaacuuuuuguucugcuuauuacugacaaccuauacugaugaagaguagauuuuuaugcuaauauucuauuauuuugugagucuugguauagacuggaaaacuauguggggaucagaccuagcagauaacaauuauauauauagaagguagguuugcuauuauaauucuuuguaccugaaugccucuccacacaaauuuauucacaggaaauaauauccuuucuaguucuuaauuaauuuuggcgaaaauuguuaaaauucucaaauuccacucucuaauuguuucaugaagaaugggcauuugcuuuucuacagugaagaacaaugggugaugaaauguugcucacaugguuuuuauaaaguauguaaugaauuucauuaugucccggauagugccaaucaaggucauuuuuaaaauaugaaggcacuuguugaagugacaagucuuagccuaucacuuuacggccaaaugaugaaucuguguaauguugaggauaagacauaagaauuucuucagaagaucaugugauguuaugaguaguuugauugagaaugugacuaacgccugccacuaggugauucucuucguuugucagaggaagaaaccaaugacuuauuccuggauauguuuuaaauucagugcaaaugcuagaacagaacacaaagauagucaaagcuaaaugcaacccgaaaguagauuaugaucuauuuacuacugucuaucauguugaacaaucaacuuuucagcuucugagcauaguaugcaggccuauuuaauguguuagaauguugaaauuagucuucagugagaaauauuuuauaauuucaaagaucaucuucaaccugaauucacagagcuaugacagagcuacaugccauuauagguccuaauuuucuguaacugucagguaaguuuuucuauuuuaagaaauuaaaaggaaaggaaagaaggcaacuagauauggacccagacauauaagcuauccuucuucaagcaaauacaaauauuucggugaaacuuuuacugaaauaucaacacucuccuauguaugugaaauucauauuaacaauuuuaauauuguguuuaauuuuuacuauuuacaauaucgugauaacggguugaauggcuugcugcugugugcacuggaaugccuauugucgggucuacauaagccugaaguuuagaaaauacuguacuagauuugauacuccaauaaggacaauagauauuucaguuaucagugaauacucagcugguagcauauuguugguguucaaaaaauauuaguugaauaaauuaaugaauuaauuacacuugccaaaaacuuauaagccaguuugcuggucuucagaaagagcgucaugaguuuuuccuaucuuaauauguuaguuaauauuuucuauuaucucugccaucuuugucuucugagaacucuagaaagagaaaugugcaucccaucacuauugucaaaauaugaaggauauuguuauuguuguuguuguuuaacuagauuuuguucuuucagcuucacauggcacauuaacauaaacaugauuugucagaggaaacugaauuuucccacacacuauuuaucucauuuuacaacacuucaggcucuaaaauacuugccagaaauugaagaugucuauuuaauaucucuaagguuguuuauugauguaauuuuugacauauuuuauaacaauuucucuccaaaugaccacauuuauaguaaauaacucugaacaccuuaaccaugaaucuuaguaacauaagugaaaacaacagguaguaucuguacacacagguaagacauuguuaaagaaauauguaaagucaaacauuaaacugcagaauaaccuaacgacauuauuuucuucuaagguaagcuuucucuuucucuccugcuccuuuucccuuucucuuccucccucuucucuucccuguguccccugcuucucuaauccacaaggcaguguuuugcucaguacauguggcugauggccuuuuguaaccucauaacauagcaaucugauuucaagcuuacauugugaauuaugguaaaaggguuagcacagacaaugauuuucuuauuucuuccccuuauucaaucucucuuuuucucuaaaaauaucucuaccucaagaagaauaaaaaacaaauucauaguaauaauccuuucuuggcaggcaacuuauuaccaaaauuaaaggacuuuacuuucuauguccaucucacuuacagaaacugaaugaaagcaguagcucaucagaagguagcacuguggacaucggcgcaccuguagaagaacagcccguaguggaaccugaagaaacucuugaaccagaagcuuguuucacugaagguaaagaaaagaauccuaauguuaaucuuucauuuggagugcagcuuguuuagcuguuggucagcuaaaauaaaucacauauaauaaaauggcacuuuguaauagauauaauucaaucaccucuaauauguugacagacaaaaaaacuuaaagucuagugucaugcuuugauuauaucugcccaauauguggaagagauuaagaacauggaggaaaaauauuuuaguaccaucaaaacuucuaacuuauauuuuuaaaguaaguagugauuucacaauaaguuggcaucuuagacacuacugaaaaugauccuacacagaauuugccuuaaaaguaacuuucugacugcuaaaacuaaacggauugcuagugcuaaauuguguuucuuuaaugaaaacaucaguuuccaauaauuguuggaugaaauggggaauaaauacugcccuagaaacucuauaccuaaacagucacuaguugagccuggugcaguaugggcaauagauagaagagauauguuuuuccuacaacuaauauuuccuguggucugauaucccugggaauuugagguuuggaaauaugcauacuuucuauuugauguuauuuuuucauaggccuaguauaccuucagucuucuucuauucccuauacaaaucaugcauaucacuuaauguccuuuucaaaacugcccucaucugaccaugguggaacagcagcuuguuccucugaauggcuguaagaaguauuuccauuuaauuuacccgauaauauacauuauccuaugaaaacucuuucucuuuuugaacaguuacauguuacuuuucuaucuuuuuucucuucuuuuccuccauuccuucacuccuuaguuccuucuuuccuccuucccuucuuuucuuccuccuuuucuccauucauucccuuucuccuuuuucuucaaacauaucuuuuccuccuuuuuuuuuuuuuugccuuggagcagggauccuguauuuauaucuuuuucuuuuuuuuuuuuuugaaaaccagauuuuuuuugguaagguucuugggaguaagguacauguucggugccuuuuuguguguguaccuaagugccuuugugcuuacaaugguacucagaaguaccuguugauugcauuuagacuaagugaaagcaaugugugaggaaggcaaugaaaagucaaagccaaaucauacaaauuagcuuuuagugaacuaaauuaauuaugcaaauuacauaagcccuucuaggcacaucacaaaaaauccuaaaugguaacaaaugcagcauuguuggaagagaucuacauuuuuacucuauauccuuuauaaaagggaaguuuucugcuuaacauuauuaauguccaauuuaaaguucuuuucuggagugacuucaacagagugcaacaggaugauaugguacaaggaaaagcuaccucacauuuauuuguaauuuacaaaguuucucuuggacaauaacacugugaggcagacaaagcaaauacuguccgcuagggcaucauuuaaaguggcugaauguuuccacaacuucacacagcugaugaaugugcucuuacuacucuaggcuuagagagcuaugcuagcaagacagagaugagcauaguaauaaaaagacaagacaaggacauugcuaaaggauauuauggaagcagagacacuuuaucuacuuuuauuucaacacuuucugcaggcuguguacaaagauucaaguguugucaaaucaauguggaagaaggcagaggaaaacaaugguggaaccugagaaggacguguuuccgaauaguugaacauaacugguuugagaccuucauuguuuucaugauucuccuuaguaguggugcucuggugagugagauuaagaaaaggugauacagcacuaauuuuuagaacacucuaauacugaugacuuauuaauccuuuguuucauugucuuaguauccaaugcauuuuuaauuaucccaccuuguaucuucuauagauuuacucuauaacucuauauuucuggauuaacuuuuacuauguauguaaauauaauuuuaagaagcuaaucauuaauuuuugcuuacuauuaaauagcccagaaaguguagcccuucagcuuauucauuaacaccaaaggaugugaauauucaauuacucauuguuuaauuaaaaaaaguuauuggaagcccugggaugggaauauauauucucugaguucugacgaauuuuguuucuaaaugguauuuauuauuauuaucucuugauggacaguaguaaguccuuagggaccacuucucugucuuuuuccaauugugugcucacuauuuuugugcuacuuaagaaauaaugaaaguugguaacaauaaauauugggcagcaugcccaagagauucauuuaaggauggguuuaucuuuauaacaagguguucacuucaucagaaucaauuuauuuuuauaggaaaauuauuuauaaaacuauaaauaaaacauacagauagcauuuuagggaaacacuaacacaaaggaaauaccauagauagaaaaagagaaagaaagagagagaaacagaguuugccugauugaaaugcaaguguguuacaaguuuaacuuuuuauaauucuaacacagacauauauuuaccuguaauuuuucugaagaaagaaauauuuucuacacgcuacuuuagaagucuuucaccguugaaaggaaugcauacuuagaagugaaacaucgagagguucauaauagaagaauauauauuagaaucuaaaugaaaaguaauuucauuuaaucauugucacacuguaugucuguugagaaacauaaauuauuaaaaaaauaacaaacaacaacaaaaaagaagcagaugaacccaacuauuuagucaaauuggagacugcgaagaucaaucacaauuucugcuuuacaaaagcacaagcuuucauuauuucuucaaccuccuuucuauagcaaaaaaaaaaaaaaaaaaaaaaagccaauagaaggaagcaaaauaaaugaaacaaaaggaauacauaacuucaaguugggauggccacaucaggauacaacaucaagaacuauuuccugacuaagucaaauuaauucauuggaaucauacuuuucuuuuucuuccaccaauagucuuuccccugauuaaauaaguaaaagaccuuugcgaggaaaaaaaaaaaguaacaguaacuacuguuucucugcccuccuauuccaaugaaaugucauaugcauaugauuaauuuuuuaaauagcuuauggaguauaauuauuuuugaaagcuaauaauguguaacauuuucuuuauaggcauuugaagauauauauauugaucagcgaaagacgauuaagacgauguuggaauaugcugacaagguuuucacuuacauuuucauucuggaaaugcuucuaaaauggguggcauauggcuaucaaacauauuucaccaaugccugguguuggcuggacuucuuaauuguugauguagguaucguucauauuuuugucucuguucaagguagcuugucuuauuuauauucaaauucuacaauagugagucucagaccacuauguuauguugacagacuauaauaaccacuaaacgcauauaugcaaugagagugucauuucuggaagacaagggcuaauuuaauucugauuuaaaauaacauugggggauggaaucuaugguaguucucuaguuaucugagaaagcuaaagaaaaaacaacacaucagcaguuuguagggaaaguagugaaacagggaacuuaaaagguauguugcuuaaauccuuuauguugugagucagacagacucaaguuuguaucccaggaccaucacuuguugauuuugugccacugaguuaguuucuuggccccaaacucuugacccccaacuuguacaguauuaaaggcacucaauaaaaacagugaugcuguugggugcuacagucauuuaaaaaaauucuauuugaucuacucaaacuuuuuaaagaguagauuuaaauaguagauuauauggauuaugacuucauuauaggaaguaagguauguagaguguagggaaagagaagucuacuuuauucagcagugaaaguuuuccuagaauguaaacuagauuuacggcaagcccaaacagcccuuuauagaauuuguauccccaaugauuaauacugcauuuacugaaaacaagugacugacuucaagauguguuaaaguuaagcaucauguuuucuauuaucaacuuggcaaaauuucagcuuuagaaagcuacagcaaaacuauccugauuucauauugaguaguuuuaccccaaaaagauacuaacccagcaagacuaugaggguuucuuguggaaaguguuucuugagcuaagaaucaugaaugcauuauauuuccuugacccugaacaaaggcaaaacuaagcuauuuaaaaaacuuaacaauguuacugugaaaugagccaauugagagaaaucucaaaggaagaauugcuuuaucacaucaauaagggagaaaguuuguaauauugagguuucaagcauuagaaguuacauuauguuucaauuucagaauuguuuacacuauaauuuaaaucuaaauguaauuuaacccuuuaaaacuuccugagguuuuuuuucuauuauguuuauuacacaucagcuuuuucaugaaaguuuuuuagugucauuuuugaaacauuuuaagaaaauaauuuuauagaaaauuuuguaguuuguaacaauaauaucuuuauuuucaauguucuguuuuaauucuuuaaugaagaucaguauagcacucuauaaaaggacuaauuacagcacaucucaaauaauguaagaaguauauuaaauaugauacaauuaauacauuuuaaaaaagaaaaguuuacaaaaauagugugcaguauaugcggaauucuccaauacuagcaucuuucuaaccaaauaaguuauaaucuuccuugaauacaaaguuuuaguaaauuccuuauuuagagaauuagauacguaagauuuuuccuuuagucauguauauuaccuacaaaugaauacaaaugaaguaaauuuauugcuguguguauuugguaaauauucauugauuggcccuuuggggccagauaucauggcagaagccauaaauuaguauaaaaaauuuugaggaaguuuuguaauggaauuucuuucuaaguuacuuauguaaaaauaaacaagugaaaaugcaagguauuaccaagacaaaauaucaccuucaaaacugauguaguucauuaauuucugagaauaccaauuaugauuaguugaauauacugaugcacaguagaaacuuccugcuuuuuuuaguacaacagcaguuuuuguauuuuauaacuagcuacaagaaaagccuuaaauucaacagcaacuuaauaaaauaaaggaagaauagccaaugaauuuuuuuccaccuugauuucuucuuuuauuuuacuaauuuuuacuuugcuuuuuuuuucuauuuauucaguugauaaauuauaugacauuuaaggauuuuuuuucaacuagcuuuuaauuaauguccuaaaaauuacauccuuuacaucaaacugaaauuauuucuuuaauuuuuuaaagguuuacugaaaaugucugaacauuuauccucugaauaauuauaagcaaaaauuauacuuguuguauuauauagcaacuacacauugaaugaugauucuguuuauuaauuguuauuauuuuugugugugcagguuucauuggucaguuuaacagcaaaugccuuggguuacucagaacuuggagccaucaaaucucucaggacacuaagagcucugagaccucuaagagccuuaucucgauuugaagggaugaggguaagaaaaaugaaagaaccugaaguauuguauauagccaaaauuaaacuaaauuaaauuuagaaaaaggaaaaucuaugcaugcaaaaggaauggcaaauucuugcaaaauugcuacuuuauuguuuuaucuguugcauauuuacuucuaggugauaugcaagagaaauaggccucucuugaaaugauauaauaucauuuaucugcugugcuuauuuaaaugacuuuauuuccuaauccaucuugggaguuuccuuacaaaucuauauacaaaaaaaagcugaugcauuauuaaaguacuauguguaaugauauaaugguaaucuaaaguaaauucuauaucagguacuuauucuuugugaugauauacuguacuuaacgaguuuuccugaaaauaaugugaaucacacaugugccuaaguaugaguguuaagaaaaaaaugaaaggaguuguuaaaacuuuugucuguauaaugccaaaguuugcauuauuugaauauauucaagauuagaugguuagauauuaaguguugacugaauuuauaaaacuaguaauacuaacuuaaagauuacauacaaauccacaucauuuuuauaacaauaaaguaaaacacuuauaaugaacagaaaauauaauuuugacucauuacuauagguaauuuauacauuaaccuuaacuugcaucuuauuggucagagucacacaaaauguuauuuuauccuuuucaaagaugcaauaaucauuuuccaucaugcauaacagauuagaaauuuugccauuauugacuuauuuuccaugccuuuuuuuacggcaugaagcauuaguuuauagauauauaauauaaaaaauuaguucugcuuuuuuuuaaaaaaaaauauuaucaaaacaaaacacugaauugugugauuccaauagaaaaacacugcucuuucaccuccuaagguguaguuacuuuuauggaaacuaagcuguauuguagacuuccauuugcacuuuguagauuguuuauagccuuauguucucuucucaagucuuauuauaaaugucacuuuguaagaacguaggacuugucuucgauuucccuaacauauaugaaaacuuuguccucauuaucgacaacucagaacaauauaauacaaguaguccucuuuuauuucucacagagagccucaaauuuucaccaaaauguuaacagaaauuaucucugggguguauaagaauuaagucuguuuuccaauuaaaugucacuuuguuuuguuucagacuggcaguuucaguucuggagaaaaaaaaugucauuuguguacauucuacuugaaaacauguugccugaaucaaaauaauauauuuuauauggcuugugaaaucugaacaaugcuaaacauuugaaaauauuauaaaccuuuuacauuugaccauuugaaaguuuauuaaauucauuggucaagugcucagauauuuccauacauuacacuucauuucuauaaaaaagcugaucuuaucgguauacuuuuaauuuucucagaaauaaccauaucuauaauuauuaaucaauaaugccuuuuauauuaaaagagguuaguuuuugaaacuuggaguuuuagacauaaaauccuuauaaaugcugauagugauauaacuaauaguuuaaauggucagauuuaugaauauggcucuauuccucauaaugacaacauacacacagcacuaaaaugacuaaucucuucaauacguguuuggcauuguagagucaaaauaacguuauaauugauucuauuuuuuauacuucuaguguuuggauauuuuauuuuguaaaaauauaaucaugaaugauggugagguuggauauaagaaugaugauuaugauugggaagugagauuugaacaugcucagaaacucucauuuaauucuuugcccuagcagcauaaaaucacaauagcugcgucaaagcguaacucaggcacucauuuuauuuuuguuguucuguuauuuuuucaaagcaugugcuuuuaugcaacauuacugaauaaagcauguuguacagugcuugauaagaaguuagaaaguaacaaauaaauuaucaucacguugcacuuuguguuuugcauguuuuaugcacauuucuggcugacagcuuuuaaacauuuauuguauuucaaauuuccaguccaaauuuuucaacuuguaaaauuaaacugagugaauugaugucgugaauaucuaggguaaaauaaaauuuguguuuaaauuuguauuuuuaauuuccuaaccuaggaaaucuuaaauaccuucuuuuucaaaagaacucaagucuuaauggauagggaaacagacggagagcaucaugaacaaaaaguaacaccaaauguucugucauaucagauuucuaacuaauaacaaacuauauauuucuauuuuguauaggauaaucuugcuccaacuuggaugggguggagcgcugguuccuccccugagcccuuuauuauggguacuguauuaccccuuuugcuaccuuuaauccuugcacugugacuuauguguaguggggugagggagggauugggaaggguacuauuauugcaccacaguagggaaaauacauuauuuacauccuaauccccucuuuucaauugucuuaaauuucauuugaaaaaaaaaaaaaccuuuaugaauuuacccucuguggauuuuaaccccaaugguugauaucuuuauuaaguuucauugaauaugauuuaguuauguguauauggaguuauccaucuuuggggagauuacuggauuggugagggcgggggacccugguguagaaugauuaugugaaaaaacaauuuaacuuguuaagcucaugauacuguuugaggcauacagccccugcuguuuaguacauuggucuggguccugaaaauuaccaguuagauaccaucaguugauuauugauauguaugagcagauacuagggugcaauauuucagguuucauaagacugguauugauugugaccacucucauuuuuuauuguguaaguucauaugggguuauuuucaaaauguuaacaaggcaaaaauauauuaagaaauaguugaauaagcacaugugaauuguguuguaaacaaaaaguuagaauaaaaaaauccacuuauuugaauuaugcagaauagaauacauaccuagaaauaaaacaaaaacgucuuaucaugaguauuaagauaaaauuuaaggcauaaacucacuucuuagaauaaguaacucccaacuaacuuucuaggauuuuaaaacauaacacagugaaaacauacauaaacauaacucuacauuuuauuuauucuuaaaguuuaaguguauuauacaagaagaagaguuuauauucgagagacagaaaaagucagaauuuuuguuuggaucaccaauauaucauagcuuacaaaaaaacugucuuaauuaaaacccacaacauaauuuuuuuagauuuuuaagaaagauucuauuauucuucuuuauacuuaaaaauggaugauuccuacuuugcccacuuuuauuuuuauucacauagauuuucuuuauuucuauuagagaagcacuagaauucaugaauaguguugauuugaaguucaaaguaauuaauucagauaaaaagacauuucugcauguaugaaaauuucuaaugugaauuugcauauuuaauuaucaauccuucauuuaguguagacuuauuuuuaaaaaugcagguaaugaaccagaaauagaauugguugugcuagaguagagaaacuuuauuugaugauuguuuugaaaaaaaagcuucugagaagaaacaaccucuaguacaguauuaauucauuaagauagcuccuuucucagacauuuccuuucauguagccugaaaguucaauuugaaauuuguucuuuccaauuuauucagacuaauucugccuacuuucuuccccccauaagaaccaauuacugcagcuuuauugagacugaaaaaaguuaauacaccuccuucuuugcugaaccaaggaauggcuuggaacucuugggaaaagacaaucuuuucuaugaucuuucauugucuaauuuaauacaucauaaauaugacuauagcuuuguauaauaaacuccccaauacugugccagauguuuucuaagauaaaguuauuuuauguucacaaaaaaaauaaaacuuuucucugggccaaauguaugccaacuuugcaaaucauauccugaagugcacugcugcagaguacaugcuugcgucauaaauuccauagaguucgcuuuaacucuaaaucaauccccaguuucaaaguaaaccucucaaacauauuaccuaagcacaaacuucucccugugcucaguuccuuaauuauucucaucccauauucagaaauaacauuuaaaaauuaugcuuugaucaauaaauacuaaucuaaacuuugcuucauuaacccauucauuuuugucaaccauuauuuuauuccuauauucaaagcucucugguauguucuuauauucaagacacucaaggcccuggaagauucacgaacauauguuugcaucuuaaauuuuuagaaaaucuuacaaucugucaggauuacacugaacucuaguacagaguaauauggguaccagauaagugggagcaacucuuccacguagacuggaaacagcacuaaaugcuauuuauaggcuacuuucugaacuuaacuuguuuuaaccucauuuuucucauaugccaaaugagaacgcaauacugaauuaucuguacaguucuguucaguacuagaauucugauucuugaauucaaaggggaaaacauuccucuuuauuuuggaggcuaaacugggggacaaaguuaggcuccaugaaagaagugcuauuugaacuaaagccuuuaagaggggagaguauuucagaagaggagcuauuagacaaggaauuucaauguaaauggcaucucaaucaccuggcaauuauauuagcacacgguuauuauauuaauugaaguggcaugaaguauagaugaccagggaaguuaaaacuggaaauauagauuguggagugaugugaauaccaagguaagaaaaauauuuguuaguuaccagagagccaauaaauaacuuucaagugggacuuggggaagauuaauucaucuuacauagauuaaaugaaggagaagguuaggagacagaugacagugcaaguaugaaauaacagagggcaguucuagguggugacugugagaauggaaaagagguggcaaagcugagaaacguuucaaagaaaaaaugugagacagguaaugugaaaagaaaaucgagaaauagguauagauaaucaguguucugcucauacucuaaauuggguguugaaggcaaaauacguauuuuaauuaguacucuguguauacacacuagaaacagcauuguaaucuggauaguggacaaaauauucagaaaagaagggaaauaguaacuugauuucaauuuccaaaucucuaaucugaaagaaaucuaauucuauucauccauuuaaaauaaauuauauaacgagaauuuaugaaguccauuguauuaaugcagacagucagaugagauaaggcaaagugucacgugucagcuugguaguugcaucggccacaucauuugguucugccuggauaacucaaccaaauuaauuuuucauacucauccccuccaccuuugucauuacugguauucuuauuuucuuuggcccacuuaucacacuguuuuauguuccccagaaggccuagaguucuuuacaggcuuuaaacagggaucagaaguauaagaaauuggcucauguauuuuuuuuucagacaggcaguuaaaaaaaauuguucuaaaaauacacuggcaucaaauggcaaauagaagauguuuugacgacuacuuccauuggaucagacugacaagaauaauacaagcacauagguggaauuaaacuuagcuauuaauguccaaguuugaggcagcugccccuuauaagcauuuuagggucuguuuuuagcuucccucuuagccacuccugugcagcuccagugggagguauggaggaaaaagcaaggaagccaucccuauguuguuuccaaacaugaacacucaagauuuuuaacuagugguccagaaguaaagagggggaaaacauccuucuauagaaaaaaaaaaaaguagauaauaauugaacacagaacuucaugugaucacaucagauuugagaacuauguauggcaucccucuuuuucuuauuuuccuaagaaaugauuucuauuauguuucauuugaaauaaguuuuuugaauuaaacucaguaaaugaaacaacugacaugacuggagcuugaaauaaacgaugugaugaucuaaugaaauacauaaugcaaauugucuugcuucuuaugcaaaaauuauuagucauagcaaugcaugaauaauuaaagacaauuauauuagguauuuaauaauauuuuuuauauuuaucaucugaauuuuuaaguuauuuuaaaaauauauuggucaaaucaacucagguccaaauguuuuaguuuuguucuuuaauauauugccuuuuuaaaaugaguuaaacuucuguauaggcuuuuuaacuuuucuuuauucugauaacacaauucugacuucaucuggcagcaaguuccucugauuuuccuuuuccuuuaaccuuuuaaugcuucucccucccuuuuuuuuaaaaacauuuuuguuucauuucuugguuauauugccuauaguuguuuuccuaaguguauugcuuaagaaaaaaaaaugaauuuuaagauuuuuuugaaccuugcuuuuacauauccuagaauaaauagcauugauagaaaaaaagaauggaaagaccagagauuacuaggggaauuuuuuuucuuuauuaacagauaagaauucugacuuuucuuuuuuuccauuuguguauuaggugguugugaaugcccuuuuaggagcaauuccauccaucaugaaugugcuucugguuugucuuauauucuggcuaauuuucagcaucaugggcguaaauuuguuugcuggcaaauucuaccacuguauuaacaccacaacuggugacagguuugacaucgaagacgugaauaaucauacugauugccuaaaacuaauagaaagaaaugagacugcucgauggaaaaaugugaaaguaaacuuugauaauguaggauuuggguaucucucuuugcuucaaguuguaagugaacacuauuuucucugaauauuuuuauuguuuggaauaauaacaaaauaaugacauacaucuauuauuuaguuccuaagaaaaaguauauauuucuuucuauuuaaaaaauuucaauuuguuaguacaaguuuaugagcccagaugggugaaaacuuuauuacauguaaggacugcagauauagucaguagugaccagaccaaacaaagaccucuuugucuuuuuucuuguauuuucuuuguuucuauauugcucuuucuauauaaacaaguaaauuaauaaaucaguaacuuugccauuuuuuauugugauuagaaggcuuguuucccugaucagcuaccaaaacggaauacacuuaacagauagaucaucuuccaaaacacauacacuuaauacaccuaauuggauuguaauuaauugguagggauuaacugcugcugaguucuauuauuuggaucaaaguuuggggaaugacauuuagguuuuagaauuagaaccaggcauagcggugggugccacugcacuccagccugggcaacaaagagugaaacuccaucuaaaaaaaaaaaaaaaaaaaaaaaaaaagagagagaauuauaccuggaagcaacuagaaacaaaaaugaagcaaaagcagcuguugucuuaucucaaaugaccuuucagcaccauuauuuaagucuauuuuguccuaaauauuaauguuuucacuacugggucucuaagacugggucuccaagaaaaauaguuuauaauuuauauuuaaaaaagguagcccuuuaaacauuuucauuugauucugcuucuagcugcagcagcaccacaacaaagcagggaauaaaauaagaguccagauuauuugaaaacucagcuuaaaaaaaaaagacuguacaauuucuuucuucccuugugguucuacagugucuuuagggcagaaaucaauuuuugcucaccaagguuaugauuucaacuguucaaccagaagacuaacuaagcaaacaaaccaacacuggucaaaacccuuuugcagcucuuccagaggugucaacuaugauuacuuuacaaauucuucccaccuuuuuguuggaaauucuuauuucucuucuuaacauuuuugaucuacucugaauaauauucaugcaauuaaaauagagauuuuuuaaaucugguaagaacggguggggcaugguggcucaugccuguaauccuagcucuuugggaggccaaagcuggaggauugcuugaggccaggagaucuagaccaguggaggcaacauagugagaccuugucucuaaagacaaauaaaaacaaaaguuaaaaaaaaucuagcaagaaugcuuucuuuaaaaauugucgacacaugaugauauuuauuugggcacuuauucuaacccuuaacuaaugaccauacuuguaaauaucacuaaagcaaccaccuccuccauaaauuugaggaaagaaaaauuaaaaauuuuaagcaauccuuuaaaauguaagcaauucugaaaauacagugaugguccugcacaaagcuauuaaauaaauucugccaccaaaaaaaaaaaaaacccucuaaaauacugcuucacauuuggcuuuuauagaaucaccucucuauugauuaguaagucauugaaauggucccuugaaucacuuuuuuguuucuauaccaaguguguaauggaauuguucuaucauugaccuaagccacugacauauuuaacacaucucucucucuuucauauacaaaagccuuguacuuucuagcuaggaaucauuacuuucuuuucacugcugucacccacacccuugcuuagcuuuugucucaugaaauccaccaccucacaaggguuagcguuaucagaacaaagauauauugugauacagacgcuaaaggcuuugcuaaccucccucacuagcuaagggauaauccuuuuaggcccacaggacucaaaauucaugccccaggacaaguaacaaauuacuguaaguuguuagccugaguauccuucauccugugagugccaagugucugcuguacuauuguucacauuucuuauucauauuaacuuauuaucuucaagaauuucagaaagaaaauagaauaggggguuauuucuaaauguuuugaugcaaaauucuuaaaaggauuguauuucuaaauguuuugcuccaaaauucuuaaaaggauaguugcaacccugccuuuauguauccugguacuauccuuacauuguuacaauaaagagaaaucuuaaauuuucaaucacuuugaucacccugcagauaaauuuuagcagaugauccuuagaucuaaguuguaauuauuuggcugauagagcuauugacccauguguuggcauuuguaagacuuucuaaaaagugcuccagcaaauuuuaauacugcuuuaaauaucaugacaccaugaacucuaaagaauugaaaagugcuugugaguugguuaucaaggggaggauauaucaaauggccauuuuguucaauauguguucuagaaaugaaaagccauacuaaaauacugucuugguccaaaaucuguguaaaauuuguuuugaaaugucuuucaaaaauauucccuuuugaaaauuauaucaguaagaauauuuauuaaacaucaggucuaaauuauuuuuacuccaaaguaaaacaugcauguccuucuuaauaggccacauucaaaggauggauggauauaauguaugcagcaguugauuccagaaauguaaguauuccuuguauucuaagucuuuuuacaauauugaucaggugguaaaauuaaucgaauaaagcauaaacgaccaaaugaaaugauucuaucuugauuuaaaauauuugggaaaaagugugacagguaaauauucaagcauagcaauguuuaucagaaagaucuuacuaagauaauucaacacaugaauuauuuugaaaaccaaaguaacaaauucauguauuuaguaacuaacaaauauuuuccuuuuaaauauuuucuauuuuguuuccuauuuauccacacauuauauaauuaguaguaauuuuagugugcgggaccaaauuugaagaaauauaugauuucuaucauuaguugaaauguauagucacccuccauauuagacagcaugaaaaguuauggauauuguucugucagccuuagauuacugugaugauuucuuucaaauaauccuauuuuaaaccauauaaaagaauguuuuuauaugauuuuugcauucauaaauugacuggagccuuuacuaauguugcaaucacuucugugaccaacagauuccuuuaaguguauaucaccaaaauauaaaccuauuuuauuugauuucagccucuuucaggcuccaagaccuaaacugaaauucaugcucauuccaacuuugcucuucaaaacuuuguaagauguaguauuuucuaucaaccuucaucuuucuauucucaagucccaucuguuuaguuuaucaucauaaagaauaaccucugucccugcagucuucaaccugauagaguuugauguuaucuuucuugaagugcauuucaaauagcuuuaguuuuauguugaauaucauuuugauaaccuccagaguuguuuuauuucacuuugucacuuauauuuuguuuuguguguuuaguugguuuuuaacuuuguugcuuuuagaaggacaugaaucuguuaaaaaacuauagugaccuuucaguccauuacuaaauuauaaguaauagcccauuuguuuuaagcacaaucuaggaauuaaauaaucaacugaggauuuauaaaauggacuguccaucuaugucuacuuaaucugaaaaauucaauaacuguuacuuuaggguaaagugccaaacaucugaaugaacaacucauuucuuauuugcuacauuauuucaugcauacaugaaugacuguuucuaaaccuagccuguagauauuuacaguuuuaaauuuuuuauuaauaauuuuaaaauuacuaaaauucaguaccuuaaaagcuugcaaauuuagcacauuacuguucaaauggaagaauauuauuuguauuuauaguuauaaaaauagauuuuagaaugucauaauagccauauuuuucacaugaaaacaucccuaaaggccaauuucagggauguuuuuuagagguaguugauucagaaaaaaaaaaaaugcugacauauuaguaagaauaauuuuuucuauuguuaugaaaaagcaccagugacauuuccagcacuaaaauguaugguaauauuuuacaaaauauuccccuuugguagguggaacuccagccuaaguaugaagaaagucuguacauguaucuuuacuuuguuauuuucaucaucuuuggguccuucuucaccuugaaccuguuuauuggugucaucauagauaauuucaaccagcagaaaaagaagauaaguauuucuaauauuuucucucccacugagauagaaaauuauuccuuggaguguuuucucugccaaaugaguacuugaauuuagaaacaaaaugggaguauauauuauaacugauuuuuccuuccucuuccucugucauucacuauccauauauuuccggcuauagaaagcuaagaauaacuguguuccacacucuuguucauagguucauaaaguuuuuccuccucuuauucauuaucaagaaacauuuucuaucuuuuaaaaaauaauaauuagaauaaaacuagaaagcaaccgaauaugccucuuucccaaaagcaauuuguuacuuuaucccuacaacuacccacucccccuugaaaauauauuuuccaacuaauucuuugcaauaaauuaggcacuggauguaagcuucuucuaguguuuauuuuuacgcuuuuuucugucauugauuucuuuuauauauucccauuucuuucuccaagauauuuaaauacaagcuauccguuucagucuugaauuguaugacuauuauuuaucauuuauaaggcucauuugauugucccaauuaccuauguacauuauagaacauauggaaaguaaauaaauaucaucacuuggaaguaacugcugccauucacauuuuguuuucuguucagaguauuucugcacauacucuuauuguuguacuuuuuaucuauaauuauaaauuccacuuuagacuuaacauaaguauuuucucauuuuguuaagucuucauauaugcauuaucauaauuuacuuauucauuccccaguagguugauaauuuagauuguuuuuaaucuuuaaugauuuaaauaguaccuuguugaaaguuuuguacaaaaaaaaagagagagggacagaaaauaaggcuuuaauuauuuccugagaauaaauucccacaaugaaguauuuuacuccccuagaguaauauaacuacucaaacucccaauaucaguguaugaacacccaugccaccguucccucacugucaccaaacauucuguuuuugaauauuugauauuuaauaggugaaaacuguauuuaauuuuaauuuuuaugacuuuuauaaccuuaauuguuaugacuuuuauguauuuuauuacauuugaacauguucuuaaaugcucauuggccauuuguauuucuuccuuuauguacuguugcuucaucucacuuguucaguagguuugcuuuuuguauaaugaaugagugcuuucuuagacuacagaacauucuccccucaauucccuuuucuuauuaccaguaguauucuuaagucaauaucaggcuacucuauuucacuuacuugccaguguuccaaucuucuaucccuacuggucugucccauacuuacuaugcuaugagcucugauuuauccccuaaaucucucacuaacucauccaguuuucuuuuuaucccuuuccuccaauucuugacagaguuagagugacuuuuuuaaugaguaacuccaaacugucuugcaguauacauccucuaacucuuugcuacauuuaaauaagaaaauuauugccuuuaacaucauaaagguaguauguauaguauaagguaccaaguauuuauuaucucagugaaccaaauuucgccacucacuaagcauaaggucuuggguaaaauacuuaaccuuuuugagauuuggggguguuugucuucauaagauaauaauaauaaagucaauuuugaauuauuuagggaauuaaauauuaucauaccuaaagaguacaauuuuuuuuacauuuuaaaucccagauauaauuauacuaaucaguugaauuuuguauuucuuuuuuuagccauccauuuucuauuuuaacauugaaaaaaauguacaaaaggacacaguuuuaaccaguuugauuuuucuuuucuauacuuuggaggucaagacaucuuuaugacagaagaacagaagaaauacuauaaugcaaugaaaaaauuaggaucgaaaaaaccgcaaaagccuauaccucgaccaggaguaagaaguaucaaaugauaugggggaaaaauacaaaaacaaaaacuugcaugcuugucucacaaaaaagaaaguagcuaacauuuccaguagaaaaaauuucuuucacuuguagagcaucaucuaaaagugauguuuguaucuuuuaugauaaugguaacaacaaaaaaaauuaaagaccaaaaaagaacaagaagaaauagaagauacacccuugacuucaagagauuuagaagcaccccauuacaauccauauuaauuggccaauggacacauagacaaugugaugugcacaagagaaaguuaaucacacaacucaagaaugguugccaaguaauaucagggaaagaaguaaaccuugggauggggcuguaagaaaugcaauuuccuaauauuuuaagaaaugaaguguugagugaaauaacaccuuacuucuauuuuauuuuucacuagagauacuaaguguuuuaaaggaggaaagaauuccaguaucuacuauucauauguauggcuauagaguuagguauuacuaaugucugcagaagucagggucaguaauuacaguuuaugaugauaaauaacaauacucaugcuuccaugaugaaauaaacaaauugcuaugaaaauguacagcuauuaucccacacuauaaauauuuuuaugaugaugaucugagagguuucaguaauuccuagggugcaucaaggaaaaaacuacuagcaaauauucauauugugaugauugaauauugccuuccugagaaugaugagaaauauauacuuucuccauuaaaauuuagcacuaagaguagaaaugaaacaacaauuuaggaaaaauauaaguuggaaaauucccucagaauuccucaguggcccaaagaaauaagccugcagauggccuucagugacuagcaguggcagaaaugggaagcagaaucacagaucaacgacaaagaacgugaaguuuuuuuugacauaaacauauaggaaaugucauucuggucucauuauccuugugcaguuucaggauucugugucugacaauguuagccaaggcuauuugguagaagaauaugaguauugccauaugugguauuuaaaugcauaauguuauagaugugucuuggaaauuccaaauucuccuuaacaauuauuugagaauacaacaagugaaauauuaauaguacuauauuuuaaaauggauguaugguccagcugaucauuggaaagucuugaaaaaaaaauuaaauggguuucuuaccuuuucauaaucuuaaaauguugauauguguugcauaccucuggaagaaguauacaguguugaauguuucuuuuguuuguuuguuuguuuguuuguuuguuuuuaucagaaaccuucuuuggauaagggauuguuauucugagaaauacacauuaguaaauggcaauuuaaauaacuaaauuuuaacaauuaauaugcuauaaaucauucuuacaaaaaucagggccaaugacuacuuugcaagaaacuagaaagucaauuaaugcagaaaguacuuaaugcuaaugcacaugagaaaacuccuuuguuguuaaaagcauuucuauuucucuacagaacaaauuucaaggaauggucuuugacuucguaaccagacaaguuuuugacauaagcaucaugauucucaucugucuuaacauggucacaaugaugguggaaacagaugaccagagugaauaugugacuaccauuuugucacgcaucaaucugguguucauugugcuauuuacuggagaguguguacugaaacucaucucucuacgccauuauuauuuuaccauuggauggaauauuuuugauuuugugguugucauucucuccauuguagguaagaaauauuuaaaguucuuaaauucaguuaaauaaaagugaaagcugaaacaaucaagauuagauucaagaucaucccagcaaucagagauaaucacuguaaauauuuugauacauuuuauccaaguguguuuguuuuuuuaacaaaaugucuccuacuauaugucaguauuguuucuuauucuauccauuuagaacaauauacuuaguguaaauguaguaaaaccucauucauuugaacuagaacugugcuauuaacuaaaauaaaaauguuuuugacauguugagauugaagaaccaauauaguaucuagaugguucuguuaacaagacuagaaauguagucugguacucacgaaaauugcuuuagagaauagacauggagucaccagcauauagauauuaguggaaagugguuucaagauaaggaaaaguauugcauaaaaagagaauaaagacaaggacuaaacauuagcaaaugcauauaguagguucucugcaagugucauguagagauuuucuagacuaccuuaaaaauggguuuaucauaaugaugcacaagggaaauaagguggcaugggacaucaucaguacuauacuucaaagccuggaacacauaacuagccucaugagcaauagcucauuucauuagacaaaacuaaagcucuaguaaaguaaaaagcaucugucugugggccuauucauucuucccuaaacaggaugauaugauugggucaauauuuuacuauccaaaacgaggcaccuguguuggacagauuuucaugccacuccccucucugaagaaacuggccuuauauccagcucauuguauauagccuuugauucccacuaauuauaauccuugguuauaacuaguguggcuaagguauaaaaguuguauucucacacgucuccuucucucucucucucucucacacacacacacacacacacacacacacacucuuacacuucgucuuuucagaaugaggcauuuaaacuugaaggcauuuaguuucuugagcucuucuuuuuaacuuuacaaguauuguuuuuaucuaaaaagcaaauggagagagaagcugaaaauaagaagacugagauuacaguguuagguacaggagaccaaaaagaauugaaauacaacauuaaguacaggauacuaaaaagagcaucaaccugggauccuuucagaaaugcaccagaacauacauaaaugaguauauaaaaauauuagaguggaauuuaaguaaguaccaagaucauggggagaugaaaguagcaucaaaagcuaccaauacuuucagauggaaaaggaguaaauagagaauuuagaauauggcaauuucagaaaaagucacuguauacauauaaacuuguaccuauacuguugggcugcuacuguucggccaaaugugcauuuuuaacuuauuuucuuuuuaaauucugacuugggacuuuacauaaacuaaaaguaguuuauaaacaucucuuaaagauaaaaaaaaguacuauaauccuuauaauugaaauuauugcugaauuucaaaauuaagauuuauaauauauuauguacaauuauauauauauuauauauaguugucauauuuaauauaacuggguucaggacucugaaccuuaccuuggagcuuuagaagaaacauauguuuauuuuaacgcaugauuucuucacugguugguauucucauuguuuauucauagguauguuucuugccgagcugauagaaaaguauuucguguccccuacccuguuccgagugauccgucuugcuaggauuggccgaauccuacgucugaucaaaggagcaaaggggauccgcacgcugcucuuugcuuugaugaugucccuuccugcguuguuuaacaucggccuccuacucuuccuagucauguucaucuacgccaucuuugggauguccaacuuugccuauguuaagagggaaguugggaucgaugacauguucaacuuugagaccuuuggcaacagcaugaucugccuauuccaaauuacaaccucugcuggcugggauggauugcuagcacccauucucaacaguaagccacccgacugugacccuaauaaaguuaacccuggaagcucaguuaagggagacugugggaacccaucuguuggaauuuucuuuuuugucaguuacaucaucauauccuuccugguuguggugaacauguacaucgcggucauccuggagaacuucaguguugcuacugaagaaagugcagagccucugagugaggaugacuuugagauguucuaugagguuugggagaaguuugaucccgaugcaacucaguucauggaauuugaaaaauuaucucaguuugcagcugcgcuugaaccgccucucaaucugccacaaccaaacaaacuccagcucauugccauggauuugcccauggugaguggugaccggauccacugucuugauaucuuauuugcuuuuacaaagcggguucuaggagagaguggagagauggaugcucuacgaauacagauggaagagcgauucauggcuuccaauccuuccaaggucuccuaucagccaaucacuacuacuuuaaaacgaaaacaagaggaaguaucugcugucauuauucagcgugcuuacagacgccaccuuuuaaagcgaacuguaaaacaagcuuccuuuacguacaauaaaaacaaaaucaaagguggggcuaaucuucuuauaaaagaagacaugauaauugacagaauaaaugaaaacucuauuacagaaaaaacugaucugaccauguccacugcagcuuguccaccuuccuaugaccgggugacaaagccaauuguggaaaaacaugagcaagaaggcaaagaugaaaaagccaaagggaaauaaaugaaaauaaauaaaaauaauugggugacaaauuguuuacagccugugaaggugauguauuuuuaucaacaggacuccuuuaggaggucaaugccaaacugacuguuuuuacacaaaucuccuuaaggucagugccuacaauaagacagugaccccuugucagcaaacugugacucuguguaaaggggagaugaccuugacaggagguuacuguucucacuaccagcugacacugcugaagauaagaugcacaauggcuagucagacuguagggaccaguuucaaggggugcaaaccugugauuuugggguuguuuaacaugaaacacuuuaguguaguaauuguauccacuguuugcauuucaacugccacauuugucacauuuuuauggaaucuguuaguggauucaucuuuuuguuaauccauguguuuauuauaugugacuauuuuuguaaacgaaguuucuguugagaaauaggcuaaggaccucuauaacagguaugccaccugggggguauggcaaccacauggcccucccagcuacacaaagucgugguuugcaugagggcaugcugcacuuagagaucaugcaugagaaaaagucacaagaaaaacaaauucuuaaauuucaccauauuucugggagggguaauugggugauaaguggaggugcuuuguugaucuuguuuugcgaaauccagccccuagaccaaguagauuauuuguggguaggccaguaaaucuuagcaggugcaaacuucauucaaauguuuggagucauaaauguuauguuucuuuuuguuguauuaaaaaaaaaaccugaauagugaauauugccccucacccuccaccgccagaagacugaauugaccaaaauuacucuuuauaaauuucugcuuuuuccugcacuuuguuuagccaucuucggcucucagcaagguugacacuguauauguuaaugaaaugcuauuuauuauguaaauagucauuuuacccuguggugcacguuugagcaaacaaauaaugaccuaagcacaguauuuauugcaucaaauauguaccacaagaaauguagagugcaagcuuuacacagguaauaaaauguauucuguaccauuuauagauaguuuggaugcuaucaaugcauguuuauauuaccaugcugcuguaucugguuucucucacugcucagaaucucauuuaugagaaaccauaugucagugguaaagucaaggaaauuguucaacagaucucauuuauuuaagucauuaagcaauaguuugcagcacuuuaacagcuuuuugguuauuuuuacauuuuaaguggauaacauaugguauauagccagacuguacagacauguuuaaaaaaacacacugcuuaaccuauuaaauauguguuuagaauuuuauaagcaaauauaaauacuguaaaaagucacuuuauuuuauuuuucagcauuauguacauaaauaugaagaggaaauuaucuucagguugauaucacaaucacuuuucuuacuuucuguccauaguacuuuuucaugaaagaaauuugcuaaauaagacaugaaaacaagacuggguaguuguagauuucugcuuuuuaaauuacauuugcuaauuuuagauuauuucacaauuuuaaggagcaaaauagguucacgauucauauccaaauuaugcuuugcaauuggaaaaggguuuaaaauuuuauuuauauuucugguaguaccugcacuaacugaauugaagguagugcuuauguuauuuuuguucuuuuuuucugacuucgguuuauguuuucauuucuuuggaguaaugcugcucuagauuguucuaaauagaaugugggcuucauaauuuuuuuuuccacaaaaacagaguagucaacuuauauagucaauuacaucaggacauuuuguguuucuuacagaagcaaaccauaggcuccucuuuuccuuaaaacuacuuagauaaacuguauucgugaacugcaugcuggaaaaugcuacuauuaugcuaaauaaugcuaaccaacauuuaaaaugugcaaaacuaauaaagauuacauuuuuuauuuua

SEQ ID NO: 6 - RNA, 84480 nt, Homo sapiens; identical to SEQ ID NO: 4

SEQ ID NO: 7 - RNA, 84480 nt, Homo sapiens; identical to SEQ ID NO: 4

SEQ ID NO: 8 - RNA, 33620 nt, Homo sapiens
ucucggcugccgcugcugccguuggcucuuauucuccuccuccuccuccucucuccuccucucugcuucucucugcuccucucuccuccucucuccuccuccuccuccuccaccuccuccuccuucucccccucuuucucccccucuuucucucuucuuucucccccguccccccgcccccuccccccaggccugaugagcaggucucgagccuccauccaucgggggagcauccccgcgauguccuaugcccccuucagagguacgugguggggggagggggagggccauauggggggcaacagggggaggggcagggggcgggggagagucggggccgagggaagggagcggcugaaauggagggagaggggaggaccgggaaggcaggggugggagcaaccgggaaggagggauuggaggccagagggauagggguagauaagggauggaggggccaggaaaugggccuugaaagggggcugaagggaaaaugaugaaggggaaagaaagcgccagaaaggggugggaagguagaaggauuggguuggggaaaaagcugcagaaauaauuugggggugggagcugagugaugaggaaaacaucaaggaaauagagggacagagucuugggagaggggcuaggaaggagaaaugaaaacauaggggugaaaagagaagccaagaagauguggggggauaauuuggugggggacucagaguaugguaaggggcggaaaaagagaggaggauggagggagagaaggggccagauggagagagagggaggcagugggggguggggggauggaggguccagauggagggaagagagaagagagagggaacggugggggaggggagaccagggcagggggagggccaaauuaugugugcuuggggggguggcaguacaaguaagaugaaaugaugggaguaggggacagguuaggauccugccccagacucugacccucuuaaaggcucuugaccaguaaaauguaaccucuggggucuuaaugcugucuucacuucaucacuuuuacccccuucccccaccccuccaauccuuauuuccauucccccucccuccucugcuguccaucaccuauaucuuuccccccauaugguguccguuccuuauaugagucccccuucuguccuuccccuauaucaguccccucucugguguucauugccucucucuuaucucuuuucuauguggucgcucccuuauaucucuaucacuucuuuacuaguccgucuugaccccuucucauagccuccgcauuaggucugccuccuuugcucugacacauguccagucgagcccuucagguguauucccuugccccugggcauuuaccaucauuucugccuccuuuucuaucuacuccuauuauuugucucccagaccauuccuugucaccacaagucugugccuacccacuuucccuuaauaccucaacucuuauuaucauuucucuuuucuugucuccucuacuuauugggguguuggagauuugggguacaaagacacagguuuugaugauuagaacaagggauccccaucucagcccuugagggauuucucauccuaguaaaaauuucccguuucucagccauguugcucugccucuugcaucugccucccagaaucauucuucaccaaguccagacaguauguguguguguguuucuagaguuguuccuaaguucccugcugccaggagaaagaugcccucugaagucuaacccgccucccuuggcugcagccugaaccagcccuuuccccaaaugcuuauguguaucaacagauuucuccucuggguauaccaagugucuaagugcggugggcauguugccugcaaugucuguaguuucagaggcuagguauuggugaucucuguaucuagagaacauuaguuagucucugagauggguugagauagaguuucaaaguaugugguuucuaaaugguggacauucugaggguucaucgcucacugugaucuggagguuggguaaauuugagagacauauuuauagacagaaaagggcugaauuugcaaaacucugcuacucagugcauucuguuggaaugaagcucaaagaccaguucuccugcaguauacucaugguuaucccauaaaggugacagaguuugaucuuuuuuccaucuaaaaucugauaccuuaagccuaauuucuagcucuuugcugucgccaaugugacaucucucuuacuucaauagggccuguguggcauugggguuuaaaggagaggcaguuugcagggagagcggcauggcaagaacaacagagcuggggaaggaggacccuggucucaucucagccauaggcgacacuuggucuacuguucucucuucucaaaguuuuguucccaucuccagcucuugucuuuggaggccccucugugucaccaggccuggauauuccauucuuucccccugacaucuuucuuccucaagcuccucacugugccuugagaaggcuccugaccuauggaguggcuuccauccuguccacugagacuagguggggugagguggugggggcaguguugaaucucugggcacugaaugggagaagagauaaauuuggucucuacuuguccaaacaagggcauauuucccaccuucugcccuggggccuccacagccagaugccgacaaaagccaucuucuccuuaccaccagaagaaccagaacuuucccuaaaggaugagcaggguugaacuaggggaggagggcacagaggagggaagaguugggaggggaggcccucucaugucucugacugugaacagguaagcuccccgacuucuucuuuucuagauauuuagcccucagaaucucaugaucccaauguuccuacacacacaccccauccuucuuucccacagccauguagcuuuccucauacucuuuuauagagggguggugccaccuuccaaguccuugucuucugcagcuauuuggaugccuuccucuacccagauaucugacaccaacuucucuguuuuucuccugccaauuuugcggcaccucuaccuuauuuuccugaaguagauggagagcuccuucaucuuucucugcccccaaacguguaccuucucugucauauaauucccaucccugaaccucugcauuucuucccccaagucuccagagccuucugugaugugauccucuccucuuuuccccuuuguauaaaugcuugucuuguguuccuuuagaguugccaggugucucacuuucaacugugaucuccugaaggccgguaggguccccuucucacuuuguggacucucuucuugccauuuuaggccucugcuuccaaaugcauagagccucccuuacuguuucugugugucucuguccuccagauguacggggacccucuaugcaccgaacccaauacguucauuccccguaugaucguccugguuggaacccucgguucugcaucaucucggggaaccagcugcucaugcuggaugaggaugaggugaguguggugagaaggcugggaaaacgcaugugggagaauggggagaguccucauuagugaaggggagagagacacaaagaaggcagacaaagaagaaacauuugcaaauggcaggaggguggccauugagacuuggguuggagugugacaagagggguagucauucucucaucuugggcagggagucuuugaggguuaugagcuguguuggggaggagaugugguucugaagauuucggggguggggaggcuccuguuuucacacuguccauauuguaggauagguuagaauggggaaggggaacugaaggguuuggagaaggggugaagacauggaaggcccucccaaccaaagcaauccucaggaccccucucugcuuugcccacugagcaagacucccaguccuuucuccaucagggggcagagugcaagaagagaaauugcaggacgcagagaaaaggcaggggauagaggagguuuuagguagcuggaggauacugggaaagaagacugaggucaguggaucuuggcaugauggggugaagacugggagagugauugagaucaagguuuagagagacacugagagggcuucugcaagggagugguuggacaucaggaaggaauauaagggaggggaacugggaguauguggaguuaucuaaaggaguacaaguggaguaggggcagggacuagccagaguaaaggagaugaaacggacagaggccucuuaugggaggugguggccagguauggagaucugagagccagggaaguguggguucugauuugggagcugggucagcaggaguguccauuggaggaaauagaggauaaaaacuggaauggugccccacaagugugagucagggaaugggggugauuugggggacaagcuuuaaaaaaugguaggguagccuggaaaaccaaacguggugagagauggacccugaaaguuauugggaauggugugaugaggaaggguuagaauuugagucagggcuaacuagagugucaagggaccuaugggggcaggugagaguguggagagauggcuggguagacagcuuccaggccacagaguaaaguagagguguuaaggagaggauauggugacuuugaaaggagagguggcuuggggagucuaaguuuuggacaccauugggagacauuugagugacuguggucaaaccccuagaucaagguuuggagucuguaggagaaaugggggaaacuggaacccagaguggggacuguuauagggaugaagagggaagacaauggauugggguaaugaaggaaugacagagauagggacagacugaagggaccaguggccagcaaguugaggggcaauaggaauggccggucuggagcaggaagggcgugugugugggaggaggaguagauagaauugggaaaaugagcagccugaacagacgcagggaguuggaauuggaugggugguggaacuggggcugggggauagugaggggucuguuccuguggcucuuuguagagguggaggagacugcagggguggagguguauggagguagggauggagguggacagggggagcugggugugaagcuuagggaaaggugauggcugaggggaagaagggaacugagagaugcugggucgggugauggaaggagaugaaaggugggggaaggugaccaggcccucuggcgggaggggagguugggucccagucuggccgcaagccgggccgugggagggagacaagcuguggauccugauuauaaaugcagcuucugcuacccccgugacaggcucggagggagagaaggggguaagggaggugggagguugggaggaaagcagggagaauggaggaacugaaggucaagggaaaacuggauucaggaaguagcuaacuucugaggaguugcagaagagcugaguaggguuugggagaauucuccggaagguguuucaagacaaauggagggagaaaagagggugggacggcaaagaaugagagagagagacugggggagagaagggagagauccagucaccaaguguggaggggccggggcagaaaaagugggcaggcuuagggggaaaaggaggcccgcccuuccugggaggaggcggaggggggaagagggaggggaggggcggcgugggccagggaggucugacacacccccaccuccccuagauacacccccuacugauccgggaccggaggagcgaguccagucgcaacaaacugcugagacgcacagucuccgugccgguggaggggcggccccacggcgagcaugguacggcggccgagcaggcucucaugacccggacaggcgcggggagagggcugaagauggaccgggcuggcggggcgggggcgucggggagcggcgggagcuggccgggggcgggagaaggcggagacaaagucuugcuucccgaggggagauggcgcccuccucuggaagguggagcgggacaggggcugugggugagaggccccuguggguccucgcucggcuucgcucccuuucuccucuccagcagugaaguuugacuauuuuccuggugcuuguaaaaauagucuccuuagaucuuuagcuuccaguccguguguuccugccccugccccucccagccccuggucugggaucuuggaaagaaugaccuaguuccugcccuccccccagaccucuuccccaccccuaugcuccugauucuucuuccggaccuucaguccuugaggucuccuuuuauuacccccuguuuucuccucucaucagcugcuucuauuuucugcaauuguaucacccuuucucuuuccucccugauuucucuuauuuucuguaccccucuugauuaccccgucccuccccucugcucccggcgaaaguccaucagacucccaucucaucuccuuucugucuguagagcuaucugcgcggucugucucuccaacucucucccucucuccaucugucucuuccccucccucccccuuucugcccccccaacccccucuuuagucauuuaaaaaaagauuuuugucuuccugagaaguucgcuuaaaagguuuccaugggaacagugaggggagaugaaggcagagaacagagaucugcagccaaggugcagagagacgcccucagcccccggaaacccccucgucacugcccccuuccacuucauuucccuucccggaccuagcgauccagguuccccauuccuccaacccccaggugaccccuuuuucccaccagcucccccucccuucaggaauucaagcuaccaguuucucucccuuagagagccagugaccuguccccauccuuuggcuccuuccagccuucugauagguccaggcccuacuagccuugugggccgguuuggggaccuuggguggguggguggguggucagggaugugugucauugucauggaaaccccauaccaucgggguguguggguagcacaucucugugaggcaaagucagguggugguggaguguauacagagaaugugugugaugucugucacaucuguguguauauguauauguguguaugucauguucaugucuggggaagauguguguguuugugugcauguguguacaccugcguuuccaggccagaauggucacaugcucacagagcauguuuaucauguguccugugguuggcagaucugcccacuuauuccccaucuuucuccuuauccugaguccucagggucuaggggucucuggcgggggucucccguguguuuuggguggggacaccguguguguuuggaguugagguggcauguggagguugcuguauugggguucaguaggggcugggagggguuccaggggcauauguauuuggggggagggcuuagugaaaguugaugggggugaacguuuagggucuucaggcagacauggaauguguaaagggcauggaggaugugcaguggacauaggggucguugggaccuuggggacuuggcaaugccaagguguuugcugaggcuguggacucuccagcccgggagaggucgccggaccuuugaggggcauuggaauccugggcuccuccucugcuggguggagccgcgaacccucguucucuccgcgguuuuguguguguggggggguccugcucaggaggggaugguggguggccugguuuguuuuggggguccccuugccccccucccccgucucucucgcgcugucuccgggcgacagggcucgugacagaggcggccacggcagcagcggucgccuagcaacggcggcggggcccgggcaacggcggcagcggcgggagcggcggcggagggagccguucccgcggccgucaccgcgcggccgucccggccgucccgggccccgccgccgcccccaccgcgccgggcggcgcgagccgggccguaccgcccccucucccuccgcaccccgcccuucccccgcgcaggggcggggccccucccccaccggggacaccccuggcccccccggggggcggugcgagguaagggcggggccgggcggacuaggagcgcgcguagaggggggggcgccgcgcgcguggggcgggggcgcgcgugugcgugggcgcggggagggggguggggaagccgcgguggcggcggcggcggcggcagcugcucccuccgcauguucucgcugcaucuuccgaguggggggaguuaugguaaccggagggggacagcggaggacgggagggucggggaccggccucgugcggacagggucuugagcacgcgggggcggccggugugugugggaucuuggagccccugguggaaggggcagcccguguguccgcguguguguucgugcccaugcucgugucuccugugugucggugccaugugcacacgggggcccaguuccucgugcacacaugugcagccauccuugugcaaguguguccugucuuaucuugccucugccuguuuccugccuagggggcuguugggccagccacgggcuuguggggcaguccgcggccuugcugguccaugucaccucugacccugagcaugcauaucccuggcuggggcucaccuccugucaggcuucugugugugggaauguguggcccuaugagcaggauuuucugugucccugguggcaggugugugucuuugcauguguguuccagcacuggccugaguaucugugucaaucccagcauggguguccagggcgugucuggaugugggugguguggcuggggggaguaagugugugaauguguuccuuggaauucuacuguguaugaaacaccuuugggcugggcagguguaagcccugcuuggucaguaaguggggacagaaaagcuuaaaaagggaagaaaugggguaaagaggaaaaguggggaggggauaggagagaaggaaugagagaggcuugaagaagagagcagagagcagcaggccagggagaaagaauagcuggagaaugggaaugugggagaaagccaagccagacuuagaagagagaacaggggauaagagcuuaagauggggaacuggauagagauggugggagaagaaggggucugggagcuggggaggcaguggggaggagagagucaggccuucugguaaagugaucucugaaagaagaaagggaagaagaugggagaaggcacuggauucuuguaggccuugcaggaucaggcuugguuuuggaucagggaaggccacucaggcauacgggcuggcucacagugaggccugucauagcagggacugucauuagagguucauauccccagcacagagcucugucucccauuucucugcucuguguccaacccuguucuucgcccuucucuggcaaccucccuccucuggcuccccuugagagcugccagcuggguguggagaggaagaaaggccaaagggaagguuagggauuuggagggcagggggagauucugugggugauggcaagauuagagauguuggaggggcaggaguccaagcccuugcugugugugugugagugccauuguguguguacacaggguguguacaugugugggugugugcacaaugccuguguuacggguuuguguagguggcuguuaugugugugcaugcguguauacaucgugcaggcaugggacauggagacccaggaucacaguuugugcuuuucagguuugcuguguguguguguacacggguguguguuguuuucucuguacaugucacugcaugcagcauuaauaacaggauguucuguguuucugucacucugcccccccuuuccucuguguuucugcuauucuuuuccugcggcaacaaaaguguuuaauaagcauauguguauguggccucuguguaccugugacuuaugagugaguucauggaucuuaguucuugguaauauguguaagguuauauuacuuccaagaaccaagcaagccaauuagcaaauuuguucuucuguuaaugcuuuaguuccaaagcggaauuuuaaugcauuuaaaguuagacuuuaugccuuuauuagaugagcuugcacaugaaaauaauggcugagcucgguucccugaaaugagagugaggcagccauaccugagaaaugcagaaaaaauguuacuagggaagagauauccugaaccauuggaugcauugcuuaguguguaccagaaggauaauuaacacauuugcuccugguuuuucuuuacucugguggcaaucucggaugccuguguuagagugagagaagggcugggggaggaaaggggguuguccugagacagaguggaugugguuguacuuuucacgugaaugaaaggauguuugugcuucugagauauggggauaccuuucuguggucaggaucaugguguacucaagcauguauuucagggguuaaacuggaauuccccugcauggggauaugugugucuuaggguuauagguccauuucuguagugugcuguccacaugauugcccaagagacuugggccacaaaguccacaccagcagcucucaugugggucacuggguucaaguauguacucccuuguugcagagcucacauaugucaaagcauguauccuguggggugugugggccucagggucucagaauguggauccgugcuaugcccgugcucacaguugucuguaugucucaaaagcacauagauccccaguuauuuuucuguauugugguucucauauacacguaccuccauagcucaguauauguuucuguacuauacaccuguuccugagggagugauaggguucucgugucaugggguccacauuuuuguaugcaaaccuccuaacaccuggguuuuacagguaaagggaagcugaggacugauucuagggcaguuugcaggcaauuugcaauucuggaagcagacagugaaaauauaauugugguccucccuuguucuguucuggaaccuagaggguuaacaggcagcucuuccgguccaccccccuccuuccagccuguagcuucuuguugccguggagaugguggccccgccccgaugcagcaccugcccccccauuggcugcaguggugacuguggggcugaggggggagcccaggccugggcagccauucuggagcuggagccggagcuuggcauccccccacuuacauucucuuccagccccucggccccucuaaauucccuugcagccgagccucagcuuccuuuuucagcgcuugccaucccucuaggcucuuggcagacugagcugcauccgcauucaccuccccuccuccuccuuucccuauccuuacuugggagucccgagaacccccacuguccauccuuccugcucccugcccauuccccugcauucuuugcuuuuccccuccccccaccaaccuucugagccccugccacugcagugcacguggaaccggcuccuucucccuuccccccaccugccccuuccuuggauuuucuguccccagcuucucccccugcuacucuucacaggucucuuccaagaccucccccuccaguccagggagggggucaugggaggcagcccuggcccuccagacagacagggguuccaggagguggggggcagguggaagaugugcccaccagggggaagaggaaagccugccuaugggcaaugaccuuuaacccaucuuuccccccagcuagccccuucuggggugggugggcaccagggaccuagccucccuggaucuuugguguccuucauuacugggguuuuacugacccucucagccaugcuccccugcugacugccagccccagucaugggccuaaggccucccaccccaucccccucagggggcuccugcucagguuccuugcccccuccuucccgcugccagccucuccgccgucgcugcucuuccugcugcuuuccgggggguaggugaggccggagcugaggggcagagggaggugggggcaugcacuggggucaggggugggaaccuggguuaacagcuucccuucuggcccccuccccaacuucccuucuggccauuuccuccccuccagaauaccacuugggucgcucgaggaggaagagugucccaggggggaagcaguacagcauggagggugccccugcugcgcccuuccggcccucggugaguggugccuaccagauguggcucaguugggcccccuccccuccagccccaacuggggcccuaggagucugagaaagagggcaggagggggagagagggagugagagugagaaaaagagugugugucugugugugucuccccaccucuuugguuucccccuucuuggcucugccccccugcuucugagaccagcccucccaccuucuccaagcuguguguguguguauaugugugugugugugugcuugcacuguacccgugggagcaaggaagacaaacugguauuaggguuccuaucccccuuuccucgccucuggagacuucccuuuuccccaucccacuuucauccaggggcucucuaccagcugagggaugaguagguagaacugacccugccccaacccaccccauccccauuucccccccagcaaggcuuccugagccgacggcuaaaaagcuccaucaaacgaacgaagucacaacccaaacuugaccggaccagcagcuuucgccagauccugccucgcuuccgaagugcugaccaugaccgguacaggggcuggagcaugugggaugagauugauguaauguagggucuccugugugagaugcagagggaggggguuaucugugugcaaagguugaaggauucaacucaaguugguugggggaugucauggcacaggggacagaacagaaaagaacuagaauagggaucugugagcagcaggagagggguaggguggcagagagaagacagacagacaggcuggaaagggaaugaaggugaagccaaggagggacuccucagggacuccucaggccaagaaggaugggcucuagcccaggaucaaaggagcuguacaggaggagagugacccuggaggaauguuuaaggaaugcagggaagggguugguaggugagugagcaauaggcuguagguggaagggugucagggaaggucaggaaauacaggggcagcagguuggaguggggcuggggguggcugaaugaauggaugauggcuagggcucaaggaccucaucagugagggaagagacaguauagagcauggcagagaaggggaggcugggacaggugugcagggugacagaaugggaagcaacccauggacugaggcaugaagaagcagccagcggagaaguccagaaggcacugucccugagaccaggcugaaggagaccuccacuguuugccuuuguugccugccauuugggguuccucucuggguuucccccucacccagucacuccccagggagaaccaugcccucccuuucccccaugucuggccacccccaggauugggcagguagggagguugggauaaagugagucacaccuuucccugccccccucccauguugccagagcuggauuuggggccggcagggggugagggcaugguauuccuggccgcgggggcggggggggggguccgggggccgggggagcgucgcgcugacggcagccagagccugcgaugacggggcugcuauaaauaacuucuuggaggcucccacacccaagcuccccucccgcuuucccacugcucucuacucuucauccccugcccaucuccauaccgcuuuuguauugcuauccuaccccucauuauuccaugccccuagcccccuuuaucuucugcccuccugcagugauuuuuuugcauuccauccccucuuagcccucaccucgguucucccggccaucucuccaguuggccuuccuccucuucuccuguccucugucuugcugcacauaccuuugucucccccuuucuucuucuugcccuaccuccucuucuucccuaguccguguauucugucuuuuauccucuuugagcucuuuucugcccacagcuuucuccuauuucuuaugcuuuucccucacucuuuccccugcuucugcuaaaacuuguccucuuaugcuguguucauucauucuuugaaucauuaaauguuuaucaggcacuagccgugugccaggcccaggcuagacauaucucuucucugugccuucacuucuuuacuuccacuuuuuccuuuauacugaggcucugguuucugggguuaccuggagguacuaccuagaagugccccaggcccacuuuguucucuccuuuuuuuuuuuucuuuucugccaugguccauuucuggguugagauauuucuagauguccccaguccucgcaaucccuuaggugugagauggugggaguuucuuuuuuuuccuuuuuuuuuuuuuaaauagaaauagggucucacuguguugcccagacuggucuugaacuccugggcucaagugacccucccaccucggccuuugaaauguugggauuacaggugugagccaccaggcccagguggagcaggggaguuccuuaaaggauucugauuuuucucacaucccucacguccuuccugauaggcaggguuucuuucugugucuguuugggaaggguguucagggggccuucucuccaagucuccauccuggaacagacugaugaugcaggguaccuaugugucuaagaagaguaggggggccgggcgcgguggcucaugccuguaaucccagcacuuugggaggcugaaucacuugaggucaggaguuugagaccagccugaccaacagggugaaaccccgucucagcuaaaaauacaaaaaaaaaaaagaaaaaaaaauuagcugggugugcugaggcaggagagacgcuugagcccaggaggcagaaguugcagcaagccgagaucacaccacuguacuccagccugggcgacagagcaagacugucucaaaaaaaaaaaaaaaaaaaaaaaaggaagagugggaagcccugaucccuuccucuccugaaccuccugccugccagggcccggcugaugcaaagcuuuaaggagucacacucucaugaguccuugcugaguccuagcagugcagcugaggcauuggagcucaacuuggaugaagauuccauuaucaagccagugcacagcuccauccugggccaggaguucuguuuugagguacugggucuggugggcuggggagggccaaaggacaggggugauggaagguggggggcagagaggucuagagaaaguggcacagguggggacaucaaggaaacagaaacuucugggacuggaggaaaggguaggccagggaggaagagaagguagcagagucuccuccccucuguagcccuuucccucaacuccacacuccuuucuagguaacaacuucaucaggaacaaaaugcuuugccugucggucugcggccgaaagagacaaauggauugagaaucugcagcgggcaguaaagcccaacaagguauuggggaauaaaggggacacaaccugugcagggcaaagguugcaccaacacgggaagcugggggccuagggaggaaagugaguuaaaggaggagaggcuuggggaaggagaggauugagguacaguguaucuggacaagcagggggagacccccauuauucugagucccccauuucuuuucgcuuucuguacugcuacccugccuuacgaucucuuucccugccauagaagucauagacuuacagaguugauggggcucuggaaauucuuuagucuagcuucccugcaggcaggaaugcuucacuaauaccccgcaggacacaucaaauacacuuagccaaguuucuguaccuugguuuccucucuaagacagagggaacugguggcaauggguuggauuaaaugaucucuaaggucccuuuggcacauaaauucuaugagucuguucuucccaaaacuucaugcuuccaguucugucagcuauucucuguaucccaguuucuagcaagcuuacaguccuagucacacuccucuggggggaacucuugugucuugauguccuuaaagaacucaacccaagaugcugacaugaucugaccuaugcagaguacaaacaccauguucccuuucaacacacugcaauaucaccugagccuuaccauuagcuugugcucaauuguauccccccaggcccuuacugauucuuuuuuuuuuuuuuuugagacagagucucacucugucacccaggcuggagugcaguggcgugaucuuggcucacugcaaccuccgccuccuggguuuaagcaauuccugugccucagccuccccaguagcugggauuacaggcaugcaccaccacacccgacuaauuuuuguauuuuuaguagagacgagguuucaccauguuggccaggcuagucucaaacuccugaccucagguugucugccugccucagccucccaaagugcuaggauuacaggcaugagccaccacaucuggccaagcuuuacccauucuauaugcaauucuuuuuucacaauuucugauagucucugcaggacuuuccaguucccuucaaauucuacauuaauauuuuuggcuuguuauuccagcuuuugaaaucuuuccaauacuguuuguguugucuaguguaugucuacgcuucuacaguagcuuccuggggcugcuauaacaaacugcuacaaacugggucacguaaaacaacagaaauuuauucucucacaguucaggaggcuggaaguccaaaagcaagguaucagcagggccacgcucucuuugaugcuguagcagggaauccuuccuugccucuuccuagcuuccggagguugccagcaguccuuggcauuccugggcuuauaacugcauccgucuaauuucugccuccaucuucauguagcuggcuuccuucugugugucucuguauccuguaucucugugucuccaaaucucccucuccauauaaagacaccaguuuuuauaagguggguuaaggguccacucuaauucaguauggccucuuuuuuuugagauggaauaucgcucuuguuucccaggcuuggagugcaauggcaugagcucagcucacugcaaccuccgccuuccagguucaagugauucuccugccucagccuccugaguagcugggauuacaggcacgugccacuaugcccagcuaauuuguuuuuguauuuuuauuagagacgggguuucacuauguuggccaggcuggcucgaacuccugaccucaggcaauccacccaccucggccucccaaagugcugggauuacaggaaugagauaccauggcuggccucuucuuaguuugauuacauuugcagggauccuguuuccaaauaagaucacauucacagguucaggguagacaugaguuuuggugggauacuauucaacccaguacaccgucucaccuuaugauugcugucuguaucccacuuucuuacugucucuccucuuuuggugucucucugucccuucccccuuuaacaucaugcccaccccaccaugccaggacaacagccgccggguagacaaugugcuaaagcuguggaucauagaggcccgggagcugccccccaagaagcgguacuacugugagcucugccuggaugacaugcuguaugcacgcaccaccuccaagccccgcucugccucuggggacaccgucuucuggggcgagcacuucgaguuuaacaaccugccggcuguccgugcccugcggcugcaucuguaccgugacucagacaaaaagcgcaagaaggacaaggcaggcuaugucggccuggugacugugccaguggccacccuggcugggcgccacuucacagagcagugguacccuguaacccugccaacaggcagugggggaucugggggcauggguucgggagggggagggggcucgggggguggcucagggggcaagggcaaaggagguugcccggcugugcggcugaaagcacguuaccagacaaugagcaucuugcccauggagcuauauaaagaguuugcagaguaugucaccaaccauuaucggaugcugugugcagucuuggagcccgcccugaaugucaaaggcaaggaggagguugccagugcacuaguucacauccugcagaguacaggcaaggccaaggugaguguugugcccucagggaaaggugacuugggaaugggcacuugcuuggggguuagugaggacagggcaaauucacgagauuggguugugcagaggcugacacuuggauuuuccugggccucaggacuuccuuucagacauggccaugucugagguagaccgguucauggaacgggagcaccucauauuccgcgagaacacgcuugccacuaaagccauagaagaguauaugagacugauuggucagaaauaccucaaggaugccauugguauggcccacacucaggcccucuucuucccaaaccugccagauguccaccccagaccccaaguccacccuuccacagcuugauacuuccuaacccagaguccuaggacuccagccuccaacaccugauucugaaauuuccccaacccuggccacccccuucccugcccuuggaaagugugaccacacccucuugugcccccaccccccaggagaauucauccgugcucuguaugaaucugaggaaaacugcgagguagacccuaucaagugcacagcauccaguuuggcagagcaccaggccaaccugcgaaugugcugugaguuggcccugugcaagguggucaacucccacuggugagacugggaacgcugggcuggggggccagggucgggggaauuauguguucaucuguucaucuaucuguccauccucaaagaggacugagcaccauuuaugggcaaagcauuguucuaggcgcuauagagcaaacaggugaaagaggccuggucccugcccucagagggccuccaccagaauggggacaaauuagaagaaaaaaaaaaaaagccacagagccauaaugguguguaagugcugaguaaggguccccccaaccucugugugacauaaggucagagagaaggcagagcuuugagauaaguggggaagaggugcccccuuggguaggcuuugaagacugguuuagguucugauauauggacauaguuggcaagaaagacauuucagaagaaggcugugagaaaggcacaugugugauggugaaaaggcccaggaguuuucaggggacauuaaaguagguuaguagcaauuacaucagguuuaguggagcaugugccucauaauggggaguggcgggagagaugucugggcaggaagauuagcuuuagaaacuggaaggccucaaggagucugaggucauugguaggccuugggaugccauuaaaggugucagaaauauugugauuuagaagauuaauccauaggcugggcacgguggcucacaccuguaauaccagcacuuugggaggcugaggcgggcagaccaccugaggucaggaguuugagaccaggcugaccaacauggagaaacccugucucuacuaaaaauacaaaauuagccagaugugguggcacaugccuguaaucccagcuauucgggaggcuaaggcaggagaaucacuugaaucugggagguggagguuguagugagccgagaucacacgauugcacucuagccugggcaacaagagugaaacuccaucucaaaaaaaaaaaauuaauccauaaguagaguguauguaguagaguagagggauguauguugggggaugacuggaauagagccagcugggggcucggaggcaugaaagucagauccugaaucagaacagugacagaaguuaggaaggagcuacuggaaggacccucucgggaaaggaucaguaggaauugucagcuuauuggaaaggagggagcaugucuguggggagucacggaugacucaagaggccaugaggcuggugguugggagaccgguggccucauugacaaccaggaaagucaggaggaggagccaguuggaggugugggggcgauggugagcucugcuuuacaccagccgaguuuaaggugucagugggacauugaaguggaacugggaggugcggggagugagcucugagccauuccagggacuggggaucaugccuggggcaccuccauccccauuucccuggaauccagaagaguugggggguccgagcucccuguaccucaagugacccuccaucucucucccaucucugucucucccuggugucuguuuuucuucuccuccucuccuugucucucucccacaccccuccaucucucucccacgugucucuccccucaccuucucucccccuccauuucucucucccuaaucugucuguucccucugccauggcccccuucuucaagcagccucccaucuugcuccugcggucccuccuucccugucucucucaccccuguuuccacacccucaccuccuaccaccccccucagcauguucccuggaagcugagggucucuggggcucagucccggucucucucuuucucucucucucucucugucuccccgacccuuccccccagcguguucccgagggagcugaaggagguguuugcuucguggcggcugcgcugcgcagagcgaggccgggaggacaucgcagacaggcuuaucagcgccucacucuuccugcgcuuccucugcccagcgauuaugucgcccagucucuuugggcuuaugcaggaguacccagaugagcagaccucacgaacccucacccucauugccaaggucauccagaaccuggccaacuuuuccaagugagggaagcuucaggagugggcagggcagggaguggcagggcagggaguggcagggcugggggucggcaagaagggucuccugaguccccagagauccugagauggggaggcuaugauaccuuguguguguguguauguguguguauguguguguguguguguguguguguguaugugaccuuuaucuucugcauucuuggcuagguuuaccucaaaggaggacuuucugggcuucaugaaugaguuucuggagcuggaaugggguuccaugcagcaguuuuuguaugagaucuccaaucuggacacgcuaaccaacagcaguagcuuugaggguuacaucgacuugggccgagagcucuccacacugcaugcccuacucugggaggugcugccccagcucagcaaggucagcagauccccucuuugcccuauccccagauggcuccagagguuccuggagccugagaaacuacccuuugaagauuuuuuuucuccccuuguuucucgaggugucaccacuacuaucccaacucaggcccccuccaccugcacccucagaggcccucuuagagcugggcacugagcccccagguaacagccucacccuuccaggaagcccuccugaagcuggguccacugccccggcuccucaacgacaucagcacagcucugaggaaccccaacauccaaaggcagccaagccgccagagugagcggccccggccucagccugugguacugcgggggccaucggcugagaugcagggcuacaugaugcgggaccucaacaggugagcacccugggacagccaggccugugcccuaggagcccuucuccuauucuagauacuccucacugggccccacaugcaucucucuagggcuugaaagaagggaggaaaaagcaccaaguucucaggggagacgauaaggagacagguacagucagugguaggcugagagcccuuuacagccugagggagugagagauuuggagcucuaggaauagggcugaggcuccaccaacucacggcuuaguuguaagccuagagcaucccugcugcaagcucugauuugcugucccucugccugcccaugcuaguccccaggcugagguucagccagcaugucaugucagccaugugucaaaauguucaaacaucucaguaauagcuagugaauaagcacuucccccagcccccgaccacaaccccacagaccuccccaugauccagcacuuagagcagugacagcagaagccuagcagggccugcagccugcuccagagucccagccuccauucugauagguggugcccgugcuucauuugcugcucauuauuuugaugauggcccugcuuuuuccucugcccgugucuuccuccaugacaccauacccaucccaccauucccgccucuccuuucauuuguccacaucucucuccuucucugucugugcucgccccucuuuccaucucucuccagcuccaucgaccuucaguccuucauggcucgaggccucaacaggugaggggcucuccccucccccgcccuccucuccucuccugucuguucccucucccacuccacuggccuucgcccuacuccucuccucuccuccuccauggaccucaucuccuccauaugugcccagcccugcccccaucccuucucuugcugcccccaucuccccuccucuaggccucacccccuucccggaggggcccuguccuuucccuuuacucaccuguccccucccauccucccugccugcccucuucagggcugccaccgcuagcucucagcccuucccucugggucccacuuuucaccccaaggccugugccagaccacagcaagguucaauugcuaggagcccugaccuuaccuucugcuugugugcccccuucccuucugacagcucuauggacauggcucgccuccccuccccaaccaaggaaaagccacccccaccaccgccugguggugguaaagaccuguucuauguaagccguccaccccuggcccguuccucaccagcauacugcacgagcagcucggacaucacagagccagagcagaagaugcugagugucaacaagaguguguccaugcuggacuuacagggugaugggccugguggccgccucaacagcagcaguguuucgaaccuggcggccguaggggaccugcugcacucaagccaggccucgcugacagcagccuuggggcuacggccugcgccugccggacgccucucccaggggaguggcucauccaucacggcggcuggcaugcgccucagccagaugggugucaccacagacggugucccugcccagcaacugcgaaucccccucuccuuccagaacccucucuuccacauggcugcugaugggccaggucccccaggcggccauggagggggcgguggccauggcccaccuuccucccaucaccaccaccaccaccaucaccaccaccgagguggagagcccccuggggacaccuuugccccauuccauggcuauagcaagagugaggaccucucuuccgggguccccaagcccccugcugccuccauccuucauagccacagcuacagugaugaguuuggacccucuggcacugacuucacccgucggcagcuuucacuccaggacaaccugcagcacaugcuguccccuccccagaucaccauugguccccagaggccagcccccucagggccuggaggugggagcggugggggcagcgguggggguggcgggggccagccgccuccauugcagaggggcaagucucagcaguugacagucagcgcagcccagaaaccccggccauccagcgggaaucuauugcaguccccagagccaaguuauggccccgcccguccacggcaacagagccucagcaaggagggcagcauugggggcagcgggggcagcgguggcggaggggguggggggcugaagcccuccaucaccaagcagguaggugaaggcaggaggaaggcgggcugggucacaacagggagggaagaaggagauggggggugggguugaaacagagucuguggccugaaguuacaaucuucuugccuccuuuuggccauuaaacaaauguguauagagggccugcuaugugccaugugcuaugccaggcacuaaggauacggcacugaacccucuuagcacucucauuccagaggggauuaauccauaaguagaaugggggugacuggaauagggccagcugggggcuuggaggcaugaagaucagauccugaaucagaacaacaggagaaauucucuggcauucaacucacaucucuggcauucagaggugauaaaggcuacagcagggcaauaggacugggacugucgucuccuuuggcugugcuguugcccucuaaauguacccugcuuuuucccaccuuuucuuucucuguucgcccucacugugccuugucccagcauucucagacaccauccacauugaaccccacaaugccagccucugagcggacaguggccugggucuccaacaugccucaccugucggcugacaucgagagugcccacaucgagcgggaagaguacaagcucaaggaguacucaaaaucgauggaugagagccggcuggauaggguacgaugggcucuaccagcuccaagccccaguguuuccuuuuacccacaggggagaucucuagucacuuccaagggaaaccuccagggucaguuauggugguaagaaaaggcaaagaccugaucaccucuugagaagccuuccguccaucuggggagaccagauacacacaguuguuaaaagucacuuucaacucuauuuuguagguuauauauaucauagacuaucuggggaucaucuauuuuaggcuuaccuccauguucuuccccaggaggaacauaagcccuggcuccugugacugcuuaggaaaggaaauguuacuuuacuggcaguaggagcuaauaaauuggauggggauggaggggguugcagcuauauuacaagugaugucuggccuacccagucacugucccaugggcauaagugacagucagugggcagggaaugcaugugguaaaguaguauguaucagucaugugugaaaagaccauccagacccucacuugguggaggcugagggcaaagggcaccaagagcucuggggcuaacacagauaacuuagcagaaaguuacuugaggaagcuguuguuccuagggccugaggaagagggcggcugcaggauuaggucauauauaaagaacauaugauccuaacacggggaaguggucuuugagcauaggaaauguugggacugacucagaugggcuugaccagcaaauuuaaugagaauuaaacccuaauauuagccccaaggcagccaccguaggaaguuaauucacaucucuccucugcauguagaaggguuggugauauauguauguauccucuucagagaaugaggaaauagucuuuugaaucauuuuuuuuucugugcuucagaugaggaaaccuuguugagaaaggcuguagacuagcacuauccaauauaacuuucugcagugaugaaauguucuguaaucuguaguguucacaugugucuaguugugauucaggaacugaauuuuuagaucuauuuaauuuuaauuuuguaauuuuuuugagacagggucuugcucugucacccaggcuggagugcaguggugcaaacauggcucgaggcaaccuccgccuccugggcucaagacauccucccaccucagcccccugaguagcuaggacuacagggucgugcuaccaugccuggcuaguuuuuuuucuuuucuuuuuuuuuuuuuuuuuuuuuuguagagacgggguuuugccauguugcccaggcuggucuagaacuugugagcucaagugaucuaccugccucagccuuccaaagugcugggauuacagguguugagccacugugccuggccuaaauuuuaaauagcuacaugugggcugguggcuaccauauuagacagcacagcuguagacucuagagccaauagggcagauaaaaugacucuucugagcucuuccagcucuggaauuccuagauucucagccuagaauucacuuguagaccuccuauccuuggcaccuugacagagccaaggagagggucacauggaggacagcaccugccuuucccccgucaauugccuuuucuuccuaugucuccagcauguguucuggggccuggcuuagggcugaagagucacccuauuuuuaauuucugagcacaguuacucaagguguguuugugaguguagguuucugugugggucuucaugaggggccauacauagaccucagggugugggagucugugaccuugcuccauuuugagggaaccucagcaccauggcagggucuucucaaaagcagguguguggauaugauccacaggcagggaagggguuggggaaggcagcuggaugucccucaacaugcaguggcugugcuuggcagacagggauggaggcuggguggugggcuugggguggggcgccccucauagugcggggucgugugcccggcgggcaggugaaggaguacgaggaggagauucacucacugaaagagcggcugcacauguccaaccggaagcuggaagaguaugagcggaggcugcugucccaggaagaacaaaccagcaaaauccugaugcaguaucaggcccgacuggagcagagugagaagaggcuaaggcagcagcaggcagagaaggauucccagaucaagagcaucauuggcaggugaggggcggccuggggaggggguugugagggagagccugaggcuggagagagcaagugggugagcuacuccgcugacucccauccccaaacucaggagcccaccaggagagcccaccacucuccuccccaggaagccacccacucacucaucaccagauggagagaaaccccaaccugcuuagugcauuaaauaucucuuuaccaaacccugaccucucuucugauagaguagcuucggaagcccuuggaaaauguaccuguuccuguccaaccaucacugcauuugcauuuacccuaggccagagcuccccacuaguuauucucaacuuaaccugugauguucacuccaaaccuaagcagggcucccuagccagaguaggcccugcccuuccuggguggacccucccucucuagccuuggaaagguguucuguuagaaagggucuuuuagccuguguauguuuucagcugcuccagcaaguccugggcuccaaagaggguauccucagcaaagaggucaauuaucuucagagugguggggucggggugggggggacccugggcgcacuccaaccagagccaccuccauuuugauccauucuaaauguauuuuauguaagauuuaauuagaagaaaagggcuucuugaaauauuuuuugaaaaccacugcucuaauugauauccuuuaugauaaaucaccucgaggaucuucacagugaggugacaugggggaugcagaagccagguccucagccauggaaggucuggggaaggggcacugcuguccugauugggacgauggaggccuggaggugucuggaugguagaagucuuugaggcacagaaagcugccuuagcagggagguguaaggguuccugggaggaagguggagagcaugauccugaggaacagggagucuugcaucacggcaauggagggacucugauucuaagggauaaggaugccugagguuuuuccagagagcuaugggguuccaugggcaggcucugagccugugcccgccacuaaccccacugaagcccgucccuucaggcugaugcugguggaggaggagcugcgccgggaccaccccgccauggcugagccgcugccagaacccaagaagaggcugcucgacgcucagguggaaauuacaaugucauuuaucuucuccgugucccauccccauccaucccacugucuuucgugcacucacuacaccagccaccuagccccaucaccaucugucucucauagucugcuguuuguccacuggcugcuccuggcagcccccuagugaccccaucuucaucccaucgucugugccuuugucacuccuggcagcgucagcccaacuccugugccuucccauccagucuucccacuccucucugcaucucaggaccuucucuaccagaaccuuggucuuucugccccuagaccccaccuaguuccaagaaccccugccccuucuuugcucacuccuauucaagccacguuguucagcuuccucugcgcucuugggccagagggcuagaagcugccguuuucuggaauagagcacagggcaguaugaucuguaguuucuccaggcccuggccgguacccugaaaacuuggggacccaucaccucuguucucuuggcucccuaauuuuccugucuccuuggcagcuccugcauagcuuccucuuccugacucuucagaucuugaaggccuuccauccuguaaccucccuuugcccucaguauuuaaguccagccucccucuggccucccucccacucuggcccucagaccuucccagcugccugcugcccagccucucuucucacaagccagcuucuaggaccucccuucugcacccuuaccccuugcuuucccaaaauucugcucauuuuccuacccauacuccucuuugcucugacugcuaggcuccccccgccugccauccccccaccaaggcuccugaccccaugaccccacucucucccacugcagcuccucaucagguaauucuccugguuccgcuuuggccacgggcggaggacacagggggaggugacuccggaccacugcagguuggucgugaagcccacucccuccaacaccuccggagccucuccccucucacugcugcccuccacacccagagaaccuccacagacuccagcccuccgacaccugcacagauccaucucccaagacaccacccaaagagagcauuugcugcugcuucccagaacuguccaacaauaccuuagcaacaccaagaguugggcccuagaugggcccagcacauucacaggucacacccacuucccugcaaaacccacccccucccagccuccuccugacucuaagcccuccucuuccucuaccucuccaguguaugucugucaccccccauuucaccagagcguccuuaggggcuggggguggguuuguuaaugggguggaggcaaugauggguuggaggaucuuggcuauaggggcugugcugacugcagcagguagguuggguuucccucuuccuucccuaaucuugguucucuacccuccuuuccacuccucaccugauucucucucuuccuccuccuuauaucugugaggcagaaggcaucugaagcucauauuagcccccauugggugggaauuaggaguggguaguuaacucagggagacuugagauacccuggaaaaaaugcuauugagauguccugacauuaggcaggguggauggaacaagaaggagcaagaaaggaaccucaggcagauguuaggacauggacuugaucauguggccugggaguuuagaaauggggagagacauccuccuagaucagaucgugggcucaguaggcauguugauucccagggagaggugccaggaacagcaugguaaagaauguacucuucacagcucacauccccagguugcugaugccacucacucccccucuccugccaucgaguggccuugccggacacaucacccuaccuaaaaagccaguaaaugagaaccugucagcuauagccaucauuucugagaugcgauuuucuuugggauugagcugcagugggcaguggcuccuuacacuguaauuuuaauucucugccugcccagccucucugucaaaguagcuggugaucuauaaagaugcuaaaaggcaccaggggacuuugccauuuaaaggacuccugcagugaauucuuuuguaaaaugaauaauggcacccuaauuuauccacuuucuaaauuuggguccauggggguguccagggcaugcuuaugugcugucaccagcagacaaacagagggaauggaaucuggggguuccuucccugcucucccgccauacucaggauacccuaccauaagugauuuccucucacugacuugcagaaaaugugugagauacccagcaagcuaagaaggcaguuuugcuggguaucucauacccaaggcugggguuugggugaucugagagguuagcuccuugauccuaggauggaagggagagcuuauauagaagcuuuuacuuggaagguuuuguauccuaaggucagacauagcuauauuaccaagccuaaaugccauguggcccaggaaauaauuuggacauuuguucuaaaccacuugugguagguauuggucucucugcaacucagccauuaauuagaaauuaguuuugagccugaauuuuaaaaagccaaguguugcccccagcccacacacacacacacggacauguacaguacaaaccccagauaauuacaacagccaaagagagaaggaagugaauuucccaaccagaagcguagggaaauucagauggcuuucuuuucucccagcagaggaacagaaggcggagcuaagggcaggaaccaggaguuggucaaggagcuauaggaggugaugagaguagaaccagggguaggagcuggucugguaccccucacccucuaauugggagcccagggagaaggacugaaaagaagaugggaguggaaaagaauaaagccaguuucugcuucccagggaugcagagauuggggcaugcugugucugcagaagcuccuagucauuuccgccauaauugugagagagaggggcagcccucccacaagauuuuucccuucccauaucacuucccugaauccccuuccuuuccccccaguacaguuaaaccucucucuaauuuggaauguuauauuugagaagauggccacugugaauaagugacaaacggaaugacagugucuauuuaaugaaaugcaugucuucaaaauauauacagaacucgaugaacaaggcuuuuuccacuccucagggagcaugcauuaaugaauagauaggauucaaaagucuguuuucugguauggguuaaauauccccuccuacagacauauuuccaccacuaauuugcuuaguacaccuuuucuucacagauaaaggaaaaugcaagcucaguuuuucuucagauuaugaagaaauuccaaauccacagggguuuggauuaaugagguuuugcuguacugccuccccuuauuccucaacaugaaguucccaccucggauuggggaugggugggaggggguuucaagaggaggagggugggaugggcaaggaauauacacaggugaagccagagaaggguuagguugggggugcggugggaacuugcuguuuugaucugguuuccuggugugacacucuggguuaaaggcuugaaggccccuguuaggagucuaggggugagauucucuucucucugaucccagaggacguuaacuucuacugcaggugagaaacaaaauaggaggaugguggggacuguccugggaggagggggugguccauggcuuguggugugggcuggcuauaggggaggccacugcuaggggacuggcauccaggcccccuugaagcgucucaauaaguccgcgcucuccuuuuuggugucuugcaggagaggcagcuuccccccuuggguccaacaaacccgcgugugacgcuggccccaccguggaauggccuggcccccccagccccaccacccccaccccggcugcagauuacggagaacggcgaguuccgaaacaccgcagaccacuagcccacccagcaucagagaccuucucuuccuuuccugugcaccccacccuguaacagcaccaaccaccaggauuggacaucaccgaggaacagcgggauugccuccccgaaugccucccugggaggcacacugauugcccacccccaccacugcaccauuuccaggagggagaguggggacccucagccgcccccuuuuccuucccauuggggugcugcccucucuuugacccccagggacccuugccccaggacaccgccuaccccguacagaccccuucacuccggggugcuauccccauccucugccucaucguuccccugagcacugggggacagacccucacccccacccuggggguguggcaccuccaaacuuucaacuucagggugauuuuuuuagcaguaaccagagcugacaaucuaacuccccuccaccgccccauuuuggccuccccugccccccuuguuauggggaggggaccccgggugagggggcccuauuaccccuugauuucucaggagcgucugggggggcucagcacgcacaaacuccuucuccuucuaccacucuuaaauuuacucccuccccacccagaacccagaugggguggagggggccaccggggcagggagggggcggcaaggggggaaugggaguugucuccccuucuccccacaccugaucugcucucggcuggucccagagcggggugagggggcuuaugccccccccucccccaguguguugggugggguggaauugagguuagggugaggggucaggguuuaggaggguguguauguugggaggacaggcuaguugaucuguccuacucugacacacaguccccucugccccuuccuucucucuucuuggucucuacucccagggggaggggggaacuuacucuaggaaaagccaugucucucucccccaggguggggggaccuguguuggaggagggguguuggggggcccccuuccaugacucuguccccugggggagguaggacagggcugggcuucccucucauccucccccucccaaucuccuuccaccucccucccucccgccagcuccacgauuuuucgguguuucucuguacauaguuuucuggcgggauaggggagguaggauggaugggguuugggguggguaggccaugggaggggagaagccccuccuuggcacccccucuucccugacugcuguccccuacccagccuugcccccuucauccuuuugcguuugguauugagacucuccuagacucuacuccucuuucuuuuguauggacaguuccccuucagucccaucccccuacacauacacccagccggggccaaauuuauacuuauauaaaaguuguaaauaugugaaauuuuaucccugugcccuuuccccaccucaggcccuaccccuggacccuccccaaccuuccuucucucuucuuuggcuguuguaauuaucugggguuuguacuguacauauccggggugugugugugugggcugggggcaacccuucuguacagagcuuccuggcccccuccccccccgccccucugcuucccuccccacccaccaccucaaggguagggaguugcucuuccuaccuguuuuauuuuguuuucucguucucccuccccaccccacucccagccuuaucuauccccccucacuguccccuuuucuccacucccagccccauuuccuuuuuuucuggaguguguggugaaacagaaaaaaacauguuuaauaaacggagauuguucuuuua

SEQ ID NO: 9 - RNA, 33618 nt, Homo sapiens
ucucggcugccgcugcugccguuggcucuuauucuccuccuccuccuccucucuccuccucucugcuucucucugcuccucucuccuccucucuccuccuccuccuccuccaccuccuccuccuucucccccucuuucucccccucuuucucucuucuuucucccccguccccccgcccccuccccccaggccugaugagcaggucucgagccuccauccaucgggggagcauccccgcgauguccuaugcccccuucagagguacgugguggggggagggggagggccauauggggggcaacagggggaggggcagggggcgggggagagucggggccgagggaagggagcggcugaaauggagggagaggggaggaccgggaaggcaggggugggagcaaccgggaaggagggauuggaggccagagggauagggguagauaagggauggaggggccaggaaaugggccuugaaagggggcugaagggaaaaugaugaaggggaaagaaagcgccagaaaggggugggaagguagaaggauuggguuggggaaaaagcugcagaaauaauuugggggugggagcugagugaugaggaaaacaucaaggaaauagagggacagagucuugggagaggggcuaggaaggagaaaugaaaacauaggggugaaaagagaagccaagaagauguggggggauaauuuggugggggacucagaguaugguaaggggcggaaaaagagaggaggauggagggagagaaggggccagauggagagagagggaggcagugggggguggggggauggaggguccagauggagggaagagagaagagagagggaacggugggggaggggagaccagggcagggggagggccaaauuaugugugcuuggggggguggcaguacaaguaagaugaaaugaugggaguaggggacagguuaggauccugccccagacucugacccucuuaaaggcucuugaccaguaaaauguaaccucuggggucuuaaugcugucuucacuucaucacuuuuacccccuucccccaccccuccaauccuuauuuccauucccccucccuccucugcuguccaucaccuauaucuuuccccccauaugguguccguuccuuauaugagucccccuucuguccuuccccuauaucaguccccucucugguguucauugccucucucuuaucucuuuucuauguggucgcucccuuauaucucuaucacuucuuuacuaguccgucuugaccccuucucauagccuccgcauuaggucugccuccuuugcucugacacauguccagucgagcccuucagguguauucccuugccccugggcauuuaccaucauuucugccuccuuuucuaucuacuccuauuauuugucucccagaccauuccuugucaccacaagucugugccuacccacuuucccuuaauaccucaacucuuauuaucauuucucuuuucuugucuccucuacuuauugggguguuggagauuugggguacaaauacacagguuuugaugauuagaacaagggauccccaucucagcccuugagggauuucucauccuaguaaaaauuucccguuucucagccauguugcucugccucuugcaucugccucccagaaucauucuucaccaaguccagacaguauguguguguguguuucuagaguuguuccuaaguucccugcugccaggagaaagaugcccucugaagucuaacccgccucccuuggcugcagccugaaccagcccuuuccccaaaugcuuauguguaucaacagauuucuccucuggguauaccaagugucuaagugcggugggcauguugccugcaaugucuguaguuucagaggcuagguauuggugaucucuguaucuagagaacauuaguuagucucugagauggguugagauagaguuucaaaguaugugguuucuaaaugguggacauucugaggguucaucgcucacugugaucuggagguuggguaaauuugagagacauauuuauagacagaaaagggcugaauuugcaaaacucugcuacucagugcauucuguuggaaugaagcucaaagaccaguucuccugcaguauacucaugguuaucccauaaaggugacagaguuugaucuuuuuuccaucuaaaaucugauaccuuaagccuaauuucuagcucuuugcugucgccaaugugacaucucucuuacuucaauagggccuguguggcauugggguuuaaaggagaggcaguuugcagggagagcggcauggcaagaacaacagagcuggggaaggaggacccuggucucaucucagccauaggcgacacuuggucuacuguucucucuucucaaaguuuuguucccaucuccagcucuugucuuuggaggccccucugugucaccaggccuggauauuccauucuuucccccugacaucuuucuuccucaagcuccucacugugccuugagaaggcuccugaccuauggaguggcuuccauccuguccacugagacuagguggggugagguggugggggcaguguugaaucucugggcacugaaugggagaagagauaaauuuggucucuacuuguccaaacaagggcauauuucccaccuucugcccuggggccuccacagccagaugccgacaaaagccaucuucuccuuaccaccagaagaaccagaacuuucccuaaaggaugagcaggguugaacuaggggaggagggcacagaggagggaagaguugggaggggaggcccucucaugucucugacugugaacagguaagcuccccgacuucuucuuuucuagauauuuagcccucagaaucucaugaucccaauguuccuacacacacaccccauccuucuuucccacagccauguagcuuuccucauacucuuuuauagagggguggugccaccuuccaaguccuugucuucugcagcuauuuggaugccuuccucuacccagauaucugacaccaacuucucuguuuuucuccugccaauuuugcggcaccucuaccuuauuuuccugaaguagauggagagcuccuucaucuuucucugcccccaaacguguaccuucucugucauauaauucccaucccugaaccucugcauuucuucccccaagucuccagagccuucugugaugugauccucuccucuuuuccccuuuguauaaaugcuugucuuguguuccuuuagaguugccaggugucucacuuucaacugugaucuccugaaggccgguaggguccccuucucacuuuguggacucucuucuugccauuuuaggccucugcuuccaaaugcauagagccucccuuacuguuucugugugucucuguccuccagauguacggggacccucuaugcaccgaacccaauacguucauuccccguaugaucguccugguuggaacccucgguucugcaucaucucggggaaccagcugcucaugcuggaugaggaugaggugaguguggugagaaggcugggaaaacgcaugugggagaauggggagaguccucauuagugaaggggagagagacacaaagaaggcagacaaagaagaaacauuugcaaauggcaggaggguggccauugagacuuggguuggagugugacaagagggguagucauucucucaucuugggcagggagucuuugaggguuaugagcuguguuggggaggagaugugguucugaagauuucggggguggggaggcuccuguuuucacacuguccauauuguaggauagguuagaauggggaaggggaacugaaggguuuggagaaggggugaagacauggaaggcccucccaaccaaagcaauccucaggaccccucucugcuuugcccacugagcaagacucccaguccuuucuccaucagggggcagagugcaagaagagaaauugcaggacgcagagaaaaggcaggggauagaggagguuuuagguagcuggaggauacugggaaagaagacugaggucaguggaucuuggcaugauggggugaagacugggagagugauugagaucaagguuuagagagacacugagagggcuucugcaagggagugguuggacaucaggaaggaauauaagggaggggaacugggaguauguggaguuaucuaaaggaguacaaguggaguaggggcagggacuagccagaguaaaggagaugaaacggacagaggccucuuaugggaggugguggccagguauggagaucugagagccagggaaguguggguucugauuugggagcugggucagcaggaguguccauuggaggaaauagaggauaaaaacuggaauggugccccacaagugugagucagggaaugggggugauuugggggacaagcuuuaaaaaaugguaggguagccuggaaaaccaaacguggugagagauggacccugaaaguuauugggaauggugugaugaggaaggguuagaauuugagucagggcuaacuagagugucaagggaccuaugggggcaggugagaguguggagagauggcuggguagacagcuuccaggccacagaguaaaguagagguguuaaggagaggauauggugacuuugaaaggagagguggcuuggggagucuaaguuuuggacaccauugggagacauuugagugacuguggucaaaccccuagaucaagguuuggagucuguaggagaaaugggggaaacuggaacccagaguggggacuguuauagggaugaagagggaagacaauggauugggguaaugaaggaaugacagagauagggacagacugaagggaccaguggccagcaaguugaggggcaauaggaauggccggucuggagcaggaagggcgugugugugggaggaggaguagauagaauugggaaaaugagcagccugaacagacgcagggaguuggaauuggaugggugguggaacuggggcugggggauagugaggggucuguuccuguggcucuuuguagagguggaggagacugcagggguggagguguauggagguagggauggagguggacagggggagcugggugugaagcuuagggaaaggugauggcugaggggaagaagggaacugagagaugcugggucgggugauggaaggagaugaaaggugggggaaggugaccaggcccucuggcgggaggggagguugggucccagucuggccgcaagccgggccgugggagggagacaagcuguggauccugauuauaaaugcagcuucugcuacccccgugacaggcucggagggagagaaggggguaagggaggugggagguugggaggaaagcagggagaauggaggaacugaaggucaagggaaaacuggauucaggaaguagcuaacuucugaggaguugcagaagagcugaguaggguuugggagaauucuccggaagguguuucaagacaaauggagggagaaaagagggugggacggcaaagaaugagagagagagacugggggagagaagggagagauccagucaccaaguguggaggggccggggcagaaaaagugggcaggcuuagggggaaaaggaggcccgcccuuccugggaggaggcggaggggggaagagggaggggaggggcggcgugggccagggaggucugacacacccccaccuccccuagauacacccccuacugauccgggaccggaggagcgaguccagucgcaacaaacugcugagacgcacagucuccgugccgguggaggggcggccccacggcgagcaugguacggcggccgagcaggcucucaugacccggacaggcgcggggagagggcugaagauggaccgggcuggcggggcgggggcgucggggagcggcgggagcuggccgggggcgggagaaggcggagacaaagucuugcuucccgaggggagauggcgcccuccucuggaagguggagcgggacaggggcugugggugagaggccccuguggguccucgcucggcuucgcucccuuucuccucuccagcagugaaguuugacuauuuuccuggugcuuguaaaaauagucuccuuagaucuuuagcuuccaguccguguguuccugccccugccccucccagccccuggucugggaucuuggaaagaaugaccuaguuccugcccuccccccagaucucuuccccaccccuaugcuccugauucuucuuccggaccuucaguccuugaggucuccuuuuauuacccccuguuuucuccucucaucagcugcuucuauuuucugcaauuguaucacccuuucucuuuccucccugauuucucuuauuuucuguaccccucuugauuaccccgucgcuccccucugcucccggcgaaaguccaucagacucccaucucaucuccuuucugucuguagagcuaucugcgcggucugucucuccaacucucucccucucuccaucugucucuuccccucccucccccuuucugcccccccaacccccucuuuagucauuuaaaaaaagauuuuugucuuccugagaaguucgcuuaaaagguuuccaugggaacagugaggggagaugaaggcagagaacagagaucugcagccaaggugcagagagacgcccucagcccccggaaacccccucgucacugcccccuuccacuucauuucccuucccggaccuagcgauccagguuccccauuccuccaacccccaggugaccccuuuuucccaccagcucccccucccuucaggaauucaagcuaccaguuucucucccuuagagagccagugaccuguccccauccuuuggcuccuuccagccuucugauagguccaggcccuacuagccuugugggccgguuuggggaccuuggguggguggguggguggucagggaugugugucauugucauggaaaccccauaccaucgggguguguggguagcacaucucugugaggcaaagucagguggugguggaguguauacagagaaugugugugaugucugucacaucuguguguauauguauauguguguaugucauguucaugucuggggaagauguguguguuugugugcauguguguacaccugcguuuccaggccagaauggucacaugcucacagagcauguuuaucauguguccugugguuggcagaucugcccacuuauuccccaucuuucuccuuauccugaguccucagggucuaggggucucuggcgggggucucccguguguuuuggguggggacaccguguguguuuggaguugagguggcauguggagguugcuguauugggguucaguaggggcugggagggguuccaggggcauauguauuuggggggagggcuuagugaaaguugaugggggugaacguuuagggucuucaggcagacauggaauguguaaagggcauggaggaugugcaguggacauaggggucguugggaccuuggggacuuggcaaugccaagguguuugcugaggcuguggacucuccagcccgggagaggucgccggaccuuugaggggcauuggaauccugggcuccuccucugcuggguggagccgcgaacccucguucucuccgcgguuuuguguguguggggggguccugcucaggaggggaugguggguggccugguuuguuuuggggguccccuugccccccucccccgucucucucgcgcugucuccgggcgacagggcucgugacagaggcggccacggcagcagcggucgccuagcaacggcggcggggcccgggcaacggcggcagcggcgggagcggcggcggagggagccguucccgcggccgucaccgcgcggccgucccggccgucccgggccccgccgccgcccccaccgcgccgggcggcgcgagccgggccguaccgcccccucucccuccgcaccccgcccuucccccgcgcaggggcggggccccucccccaccggggacaccccuggcccccccggggggcggugcgagguaagggcggggccgggcggacuaggagcgcgcguagaggggggggcgccgcgcgcguggggcgggggcgcgcgugugcgugggcgcggggagggggguggggaagccgcgguggcggcggcggcggcggcagcugcucccuccgcauguucucgcugcaucuuccgaguggggggaguuaugguaaccggagggggacagcggaggacgggagggucggggaccggccucgugcggacagggucuugagcacgcgggggcggccggugugugugggaucuuggagccccugguggaaggggcagcccguguguccgcguguguguucgugcccaugcucgugucuccugugugucggugccaugugcacacgggggcccaguuccucgugcacacaugugcagccagccuugugcaaguguguccugucuuaucuugccucugccuguuuccugccuagggggcuguugggccagccacgggcuuguggggcaguccgcggccuugcugguccaugucaccucugacccugagcaugcauaucccuggcuggggcucaccuccugucaggcuucugugugugggaauguguggcccuaugagcaggauuuucugugucccugguggcaggugugugucuuugcauguguguuccagcacuggccugaguaucugugucaaucccagcauggguguccagggcgugucuggaugugggugguguggcuggggggaguaagugugugaauguguuccuuggaauucuacuguguaugaaacaccuuugggcugggcagguguaagcccugcuuggucaguaaguggggacagaaaagcuuaaaaagggaagaaaugggguaaagaggaaaaguggggaggggauaggagagaaggaaugagagaggcuugaagaagagagcagagagcagcaggccagggagaaagaauagcuggagaaugggaaugugggagaaagccaagccagacuuagaagagagaacaggggauaagagcuuaagauggggaacuggauagagauggugggagaagaaggggucugggagcuggggaggcaguggggaggagagagucaggccuucugguaaagugaucucugaaagaagaaagggaagaagaugggagaaggcacuggauucuuguaggccuugcaggaucaggcuugguuuuggaucagggaaggccacucaggcauacgggcuggcucacagugaggccugucauagcagggacugucauuagagguucauauccccagcacagagcucugucucccauuucucugcucuguguccaacccuguucuucgcccuucucuggcaaccucccuccucuggcuccccuugagagcugccagcuggguguggagaggaagaaaggccaaagggaagguuagggauuuggagggcagggggagauucugugggugauggcaagauuagagauguuggaggggcaggaguccaagcccuugcugugugugugugagugccauuguguguguacacaggguguguacaugugugggugugugcacaaugccuguguuacggguuuguguagguggcuguuaugugugugcaugcguguauacaucgugcaggcaugggacauggagacccaggaucacaguuugugcuuuucagguuugcuguguguguguguacacggguguguguuguuuucucuguacaugucacugcaugcagcauuaauaacaggauguucuguguuucugucacucugcccccccuuuccucuguguuucugcuauucuuuuccugcggcaacaaaaguguuuaauaagcauauguguauguggccucuguguaccugugacuuaugagugaguucauggaucuuaguucuugguaauauguguaagguuauauuacuuccaagaaccaagcaagccaauuagcaaauuuguucuucuguuaaugcuuuaguuccaaagcggaauuuuaaugcauuuaaaguuagacuuuaugccuuuauuagaugagcuugcacaugaaaauaauggcugagcucgguucccugaaaugagagugaggcagccauaccugagaaaugcagaaaaaauguuacuagggaagagauauccugaaccauuggaugcauugcuuaguguguaccagaaggauaauuaacacauuugcuccugguuuuucuuuacucugguggcaaucucggaugccuguguuagagugagagaagggcugggggaggaaaggggguuguccugagacagaguggaugugguuguacuuuucacgugaaugaaaggauguuugugcuucugagauauggggauaccuuucuguggucaggaucaugguguacucaagcauguauuucagggguuaaacuggaauuccccugcauggggauaugugugucuuaggguuauagguccauuucuguagugugcuguccacaugauugcccaagagacuugggccacaaaguccacaccagcagcucucaugugggucacuggguucaaguauguacucccuuguugcagagcucacauaugucaaagcauguauccuguggggugugugggccucagggucucagaauguggauccgugcuaugcccgugcucacaguugucuguaugucucaaaagcacauagauccccaguuauuuuucuguauugugguucucauauacacguaccuccacagcucaguauauguuucuguacuauacaccuguuccugagggagugauaggguucucgugucaugggguccacauuuuuguaugcaaaccuccuaacaccuggguuuuacagguaaagggaagcugaggacugauucuagggcaguuugcaggcaauuugcaauucuggaagcagacagugaaaauauaauugugguccucccuuguucuguucuggaaccuagaggguuaacaggcagcucuuccgguccaccccccuccuuccagccuguagcuucuuguugccguggagaugguggccccgccccgaugcagcaccugcccccccauuggcugcaguggugacuguggggcugaggggggagcccaggccugggcagccauucuggagcuggagccggagcuuggcauccccccacuuacauucucuuccagccccucggccccucuaaauucccuugcagccgagccucagcuuccuuuuucagcgcuugccaucccucuaggcucuuggcagacugagcugcauccgcauucaccuccccuccuccuccuuucccuauccuuacuugggagucccgagaacccccacuguccauccuuccugcucccugcccauuccccugcauucuuugcuuuuccccuccccccaccaaccuucugagccccugccacugcagugcacguggaaccggcuccuucucccuuccccccaccugccccuuccuuggauuuucuguccccagcuucucccccugcuacucuucacaggucucuuccaagaccucccccuccaguccagggagggggucaugggaggcagcccuggcccuccagacagacagggguuccaggagguggggggcagguggaagaugugcccaccagggggaagaggaaagccugccuaugggcaaugaccuuuaacccaucuuuccccccagcuagccccuucuggggugggugggcaccagggaccuagccucccuggaucuuugguguccuucauuacugggguuuuacugacccucucagucaugcuccccugcugacugccagccccagucaugggccuaaggccucccaccccaucccccucagggggcuccugcucagguuccuugcccccuccuucccgcugccagccucuccgccgucgcugcucuuccugcugcuuuccgggggguaggugaggccggagcugaggggcagagggaggugggggcaugcacuggggucaggggugggaaccuggguuaacagcuucccuucuggcccccuccccaacuucccuucuggccauuuccuccccuccagaauaccacuugggucgcucgaggaggaagagugucccaggggggaagcaguacagcauggagggugccccugcugcgcccuuccggcccucggugaguggugccuaccagauguggcucaguugggcccccuccccuccagccccaacuggggcccuaggagucugagaaagagggcaggagggggagagagggagugagagugagaaaaagagugugugucugugugugucuccccaccucuuugguuucccccuucuuggcucugccccccugcuucugagaccagcccucccaccuucuccaagcuguguguguguguauaugugugugugugugugcuugcacuguacccgugggagcaaggaagacaaacugguauuaggguuccuaucccccuuuccucgccucuggagacuucccuuuuccccaucccacuuucauccaggggcucucuaccagcugagggaugaguagguagaacugacccugccccaacccaccccauccccauuucccccccagcaaggcuuccugagccgacggcuaaaaagcuccaucaaacgaacgaagucacaacccaaacuugaccggaccagcagcuuucgccagauccugccucgcuuccgaagugcugaccaugaccgguacaggggcuggagcaugugggaugagauugauguaauguagggucuccugugugagaugcagagggaggggguuaucugugugcaaagguugaaggauucaacucaaguugguugggggaugucauggcacaggggacagaacagaaaagaacuagaauagggaucugugagcagcaggagagggguaggguggcagagagaagacagacagacaggcuggaaagggaaugaaggugaagccaaggagggacuccucagggacuccucaggccaagaaggaugggcucuagcccaggaucaaaggagcuguacaggaggagagugacccuggaggaauguuuaaggaaugcagggaagggguugguaggugagugagcaauaggcuguagguggaagggugucagggaaggucaggaaauacaggggcagcagguuggaguggggcuggggguggcugaaugaauggaugauggcuagggcucaaggaccucaucagugagggaagagacaguauagagcauggcagagaaggggagggugggacaggugugcagggugacagaaugggaagcaacccauggacugaggcaugaagaagcagccagcggagaaguccagaaggcacugucccugagaccaggcugaaggagaccuccacuguuugccuuuguugccugccauuugggguuccucucuggguuucccccucacccagucacuccccagggagaaccaugcccucccuuucccccaugucuggccacccccaggauugggcagguagggagguugggauaaagugagucacaccuuucccugccccccucccauguugccagagcuggauuuggggccggcagggggugagggcaugguauuccuggccgcgggggcggggggggggguccgggggccgggggagcgucgcgcugacggcagccagagccugcgaugacggggcugcuauaaauaacuucuuggaggcucccacacccaagcuccccucccgcuuucccacugcucucuacucuucauccccugcccaucuccauaccgcuuuuguauugcuauccuaccccucauuauuccaugccccuagcccccuuuaucuucugcccuccugcagugauuuuuuugcauuccauccccucuuagcccucaccucgguucucccggccaucucuccaguuggccuuccuccucuucuccuguccucugucuugcugcacauaccuuugucucccccuuucuucuucuugcccuaccuccucuucuucccuagucccuguauucugucuuuuauccucuuugagcucuuuucugcccacagcuuucuccuauuucuuaugcuuuucccucacucuuuccccugcuucugcuaaaacuuguccucuuaugcuguguucauucauucuuugaaucauuaaauguuuaucaggcacuagccgugugccaggcccaggcuagacauaucucuucucugugccuucacuucuuuacuuccacuuuuuccuuuauacugaggcucugguuucugggguuaccuggagguacuaccuagaagugccccaggcccacuuuguucucuccuuuuuuuuuuuucuuuucugccaugguccauuucuggguugagauauuucuagauguccccaguccucgcaaucccuuaggugugagauggugggaguuucuuuuuuuuccuuuuuuuuuuuuaaauagaaauagggucucacuguguugcccagacuggucuugaacuccugggcucaagugacccucccaccucggccuuugaaauguugggauuacaggugugagccaccaggcccagguggagcaggggaguuccuuaaaggauucugauuuuucucacaucccucacguccuuccugauaggcaggguuucuuucugugucuguuugggaaggguguucagggggccuucucuccaagucuccauccuggaacagacugaugaugcaggguaccuaugugucuaagaagaguaggggggccgggcgcgguggcucaugccuguaaucccagcacuuugggaggcugaaucacuugaggucaggaguuugagaccagccugaccaacagggugaaaccccgucucagcuaaaaauacaaaaaaaaaaaagaaaaaaaaauuagcugggugugcugaggcaggagagacgcuugagcccaggaggcagaaguugcagcaagccgagaucacaccacuguacuccagccugggcgacagagcaagacugucucaaaaaaaaaaaaaaaaaaaaaaaaaggaagagugggaagcccugaucccuuccucuccugaaccuccugccugccagggcccggcugaugcaaagcuuuaaggagucacacucucaugaguccuugcugaguccuagcagugcagcugaggcauuggagcucaacuuggaugaagauuccauuaucaagccagugcacagcuccauccugggccaggaguucuguuuugagguacugggucuggugggcuggggagggccaaaggacaggggugauggaagguggggggcagagaggucuagagaaaguggcacagguggggacaucaaggaaacagaaacuucugggacuggaggaaaggguaggccagggaggaagagaagguagcagagucuccuccccucuguagcccuuucccucaacuccacacuccuuucuagguaacaacuucaucaggaacaaaaugcuuugccugucggucugcggccgaaagagacaaauggauugagaaucugcagcgggcaguaaagcccaacaagguauuggggaauaaaggggacacaaccuguguagggcaaagguugcaccaacacgggaagcugggggccuagggaggaaagugaguuaaaggaggagaggcuuggggaaggagaggauugagguacaguguaucuggacaagcagggggagacccccauuauucugagucccccauuucuuuucgcuuucuguacugcuacccugccuuacgaucucuuucccugccauagaagucauagacuuacagaguugauggggcucuggaaauucuuuagucuagcuucccugcaggcaggaaugcuucacuaauaccccgcaggacacaucaaauacacuuagccaaguuucuguaccuugguuuccucucuaagacagagggaacugguggcaauggguuggauuaaaugaucucuaaggucccuuuggcacauaaauucuaugagucuguucuucccaaaacuucaugcuuccaguucugucagcuauucucuguaucccaguuucuagcaagcuuacaguccuagucacacuccucuggggggaacucuugugucuugauguccuuaaagaacucaacccaagaugcugacaugaucugaccuaugcagaguacaaacaccauguucccuuucaacacacugcaauaucaccugagccuuaccauuagcuugugcucaauuguauccccccaggcccuuacugauucuuuuuuuuuuuuuuuugagacagagucucacucugucacccaggcuggagugcaguggcgugaucuuggcucacugcaaccuccgccuccuggguuuaagcaauuccugugccucagccuccccaguagcugggauuacaggcaugcaccaccacacccgacuaauuuuuguauuuuuaguagagacgagguuucaccauguuggccaggcuagucucaaacuccugaccucagguugucugccugccucagccucccaaagugcuaggauuacaggcaugagccaccacaucuggccaagcuuuacccauucuauaugcaauucuuuuuucacaauuucugauagucucugcaggacuuuccaguucccuucaaauucuacauuaauauuuuuggcuuguuauuccagcuuuugaaaucuuuccaauacuguuuguguugucuaguguaugucuacgcuucuacaguagcuuccuggggcugcuauaacaaacugcuacaaacugggucacguaaaacaacagaaauuuauucucucacaguucaggaggcuggaaguccaaaagcaagguaucagcagggccacgcucucuuugaugcuguagcagggaauccuuccuugccucuuccuagcuuccggagguugccagcaguccuuggcauuccugggcuuauaacugcauccgucuaauuucugccuccaucuucauguagcuggcuuccuucugugugucucuguauccuguaucucugugucuccaaaucucccucuccauauaaagacaccaguuuuuauaagguggguuaaggguccacucuaauucaguauggccucuuuuuuuugagauggaauaucgcucuuguuucccaggcuuggagugcaauggcaugagcucagcucacugcaaccuccgccuuccagguucaagugauucuccugccucagccuccugaguagcugggauuacaggcacgugccacuaugcccagcuaauuuguuuuuguauuuuuauuagagacgggguuucacuauguuggccaggcuggcucgaacuccugaccucaggcaauccacccaccucggccucccaaagugcugggauuacaggaaugagauaccauggcuggccucuucuuaguuugauuacauuugcagggauccuguuuccaaauaagaucacauucacagguucaggguagacaugaguuuuggugggauacuauucaacccaguacaccgucucaccuuaugauugcugucuguaucccacuuucuuacugucucuccucuuuuggugucucucugucccuucccccuuuaacaucaugcccaccccaccaugccaggacaacagccgccggguagacaaugugcuaaagcuguggaucauagaggcccgggagcugccccccaagaagcgguacuacugugagcucugccuggaugacaugcuguaugcacgcaccaccuccaagccccgcucugccucuggggacaccgucuucuggggcgagcacuucgaguuuaacaaccugccggcuguccgugcccugcggcugcaucuguaccgugacucagacaaaaagcgcaagaaggacaaggcaggcuaugucggccuggugacugugccaguggccacccuggcugggcgccacuucacagagcagugguacccuguaacccugccaacaggcagugggggaucugggggcauggguucgggagggggagggggcucgggggguggcucagggggcaagggcaaaggagguugcccggcugugcggcugaaagcacguuaccagacaaugagcaucuugcccauggagcuauauaaagaguuugcagaguaugucaccaaccauuaucggaugcugugugcagucuuggagcccgcccugaaugucaaaggcaaggaggagguugccagugcacuaguucacauccugcagaguacaggcaaggccaaggugaguguugugcccucagggaaaggugacuugggaaugggcacuugcuuggggguuagugaggacagggcaaauucacgagauuggguugugcagaggcugacacuuggauuuuccugggccucaggacuuccuuucagacauggccaugucugagguagaccgguucauggaacgggagcaccucauauuccgcgagaacacgcuugccacuaaagccauagaagaguauaugagacugauuggucagaaauaccucaaggaugccauugguauggcccacacucaggcccucuucuucccaaaccugccagauguccaccccagaccccaaguccacccuuccacagcuugauacuuccuaacccagaguccuaggacuccagccuccaacaccugauucugaaauuuccccaacccuggccacccccuucccugcccuuggaaagugugaccacacccucuugugcccccaccccccaggagaauucauccgugcucuguaugaaucugaggaaaacugcgagguagacccuaucaagugcacagcauccaguuuggcagagcaccaggccaaccugcgaaugugcugugaguuggcccugugcaagguggucaacucccacuggugagacugggaacgcugggcuggggggccagggucgggggaauuauguguucaucuguucaucuaucuguccauccucaaagaggacugagcaccauuuaugggcaaagcauuguucuaggcgcuauagagcaaacaggugaaagaggccuggucccugcccucagagggccuccaccagaauggggacaaauuagaagaaaaaaaaaaaaagccacagagccauaaugguguguaagugcugaguaaggguccccccaaccucugugugacauaaggucagagagaaggcagagcuuugagauaaguggggaagaggugcccccuuggguaggcuuugaagacugguuuagguucugauauauggacauaguuggcaagaaagacauuucagaagaaggcugugagaaaggcacaugugugauggugaaaaggcccaggaguuuucaggggacauuaaaguagguuaguagcaauuacaucagguuuaguggagcaugugccucauaauggggaguggcgggagagaugucugggcaggaagauuagcuuuagaaacuggaaggccucaaggagucugaggucauugguaggccuugggaugccauuaaaggugucagaaauauugugauuuagaagauuaauccauaggcugggcacgguggcucacaccuguaauaccagcacuuugggaggcugaggcgggcagaccaccugaggucaggaguuugagaccaggcugaccaacauggagaaacccugucucuacuaaaaauacaaaauuagccagaugugguggcacaugccuguaaucccagcuauucgggaggcuaaggcaggagaaucacuugaaucugggagguggagguuguagugagccgagaucacaccauugcacucuagccugggcaacaagagugaaacuccgucucaaaaaaaaaaaauuaauccauaaguagaguguauguaguagaguagagggauguauguugggggaugacuggaauagagccagcugggggcucggaggcaugaaagucagauccugaaucagaacagugacagaaguuaggaaggagcuacuggaaggacccucucgggaaaggaucaguaggaauugucagcuuauuggaaaggagggagcaugucuguggggagucacggaugacucaagaggccaugaggcuggugguugggagaccgguggccucauugacaaccaggaaagucaggaggaggagccaguuggaggugugggggcgauggugagcucugcuuuacaccagccgaguuuaaggugucagugggacauugaaguggaacugggaggugcggggagugagcucugagccauuccagggacuggggaucaugccuggggcaccuccauccccauuucccuggaauccagaagaguugggggguccgagcucccuguaccucaagugacccuccaucucucucccaucucugucucucccuggugucuguuuuucuucuccuccucuccuugucucucucccacaccccuccaucucucucccacgugucucuccccucaccuucucucccccuccauuucucucucccuaaucugucuguucccucugccauggcccccuucuucaagcagccucccaucuugcuccugcggucccuccuucccugucucucucaccccuguuuccacacccucaccuccuaccaccccccucagcauguucccuggaagcugagggucucuggggcucagucccggucucucucuuucucucucucucucucugucuccccgacccuuccccccagcguguucccgagggagcugaaggagguguuugcuucauggcggcugcgcugcgcagagcgaggccgggaggacaucgcagacaggcuuaucagcgccucacucuuccugcgcuuccucugcccagcgauuaugucgcccagucucuuugggcuuaugcaggaguacccagaugagcagaccucacgaacccucacccucauugccaaggucauccagaaccuggccaacuuuuccaagugagggaagcuucaggagugggcagggcagggaguggcagggcagggaguggcagggcugggggucggcaagaagggucuccugaguccccagagauccugagauggggaggcuaugauaccuuguguguguguguauguguguguauguguguguguguguguguguguguguaugugaccuuuaucuucugcauucuuggcuagguuuaccucaaaggaggacuuucugggcuucaugaaugaguuucuggagcuggaaugggguuccaugcagcaguuuuuguaugagaucuccaaucuggacacgcuaaccaacagcaguagcuuugaggguuacaucgacuugggccgagagcucuccacacugcaugcccuacucugggaggugcugccccagcucagcaaggucagcagauccccucuuugcccuauccccagauggcuccagagguuccuggagccugagaaacuacccuuugaagauuuuuuuucuccccuuguuucucgaggugucaccacuacuaucccaacucaggcccccuccaccugcacccucagaggcccucuuagagcugggcacugagcccccagguaacagccucacccuuccaggaagcccuccugaagcuggguccacugccccggcuccucaacgacaucagcacagcucugaggaaccccaacauccaaaggcagccaagccgccagagugagcggccccggccucagccugugguacugcgggggccaucggcugagaugcagggcuacaugaugcgggaccucaacaggugagcacccugggacagccaggccugugcccuaggagcccuucuccuauucuagauacuccucacugggccccacaugcaucucucuagggcuugaaagaagggaggaaaaagcaccaaguucucaggggagacgauaaggagacagguacagucagugguaggcugagagcccuuuacagccugagggagugagagauuuggagcucuaggaauagggcugaggcuccaccaacucacggcuuaguuguaagccuagagcaucccugcugcaagcucugauuugcugucccucugccugcccaugcuaguccccaggcugagguucagccagcaugucaugucagccaugugucaaaauguucaaacaucucaguaauagcuagugaauaagcacuucccccagcccccgaccacaaccccacagaccuccccaugauccagcacuuagagcagugacagcagaagccuagcagggccugcagccugcuccagagucccagccuccauucugauagguggugcccgugcuucauuugcugcucauuauuuugaugauggcccugcuuuuuccucugcccgugucuuccuccaugacaccauacccaucccaccauucccgccucuccuuucauuuguccacaucucucuccuucucugucugugcucgccccucuuuccaucucucuccagcuccaucgaccuucaguccuucauggcucgaggccucaacaggugaggggcucuccccucccccgcccuccucuccucuccugucuguucccucucccacuccacuggccuucgcccuacuccucuccucuccuccuccauggaccucaucuccuccauaugugcccagcccugcccccaucccuucucuugcugcccccaucuccccuccucuaggccucacccccuucccggaggggcccuguccuuucccuuuacucaccuguccccucccauccucccugccugcccucuucagggcugccaccgcuagcucucagcccuucccucugggucccacuuuucaccccaaggccugugccagaccacagcaagguucaauugcuaggagcccugaccuuaccuucugcuugugugcccccuucccuucugacagcucuauggacauggcucgccuccccuccccaaccaaggaaaagccacccccaccaccgccugguggugguaaagaccuguucuauguaagccguccaccccuggcccguuccucaccagcauacugcacgagcagcucggacaucacagagccagagcagaagaugcugagugucaacaagaguguguccaugcuggacuuacagggugaugggccugguggccgccucaacagcagcaguguuucgaaccuggcggccguaggggaccugcugcacucaagccaggccucgcugacagcagccuuggggcuacggccugcgccugccggacgccucucccaggggaguggcucauccaucacggcggcuggcaugcgccucagccagaugggugucaccacagacggugucccugcccagcaacugcgaaucccccucuccuuccagaacccucucuuccacauggcugcugaugggccaggucccccaggcggccauggagggggcgguggccauggcccaccuuccucccaucaccaccaccaccaccaucaccaccaccgagguggagagcccccuggggacaccuuugccccauuccauggcuauagcaagagugaggaccucucuuccgggguccccaagcccccugcugccuccauccuucauagccacagcuacagugaugaguuuggacccucuggcacugacuucacccgucggcagcuuucacuccaggacaaccugcagcacaugcuguccccuccccagaucaccauugguccccagaggccagcccccucagggccuggaggugggagcggugggggcagcgguggggguggcgggggccagccgccuccauugcagaggggcaagucucagcaguugacagucagcgcagcccagaaaccccggccauccagcgggaaucuauugcaguccccagagccaaguuauggccccgcccguccacggcaacagagccucagcaaggagggcagcauugggggcagcgggggcagcgguggcggaggggguggggggcugaagcccuccaucaccaagcagguaggugaaggcaggaggaaggcgggcugggucacaacagggagggaagaaggagauggggggugggguugaaacagagucuguggccugaaguuacaaucuucuugccuccuuuuggccauuaaacaaauguguauagagggccugcuaugugccaugugcuaugccaggcacuaaggauacggcacugaacccucuuagcacucucauuccagaggggauuaauccauaaguagaaugggggugacuggaauagggccagcugggggcuuggaggcaugaagaucagauccugaaucagaacaacaggagaaauucucuggcauucaacucacaucucuggcauucagaggugauaaaggcuacagcagggcaauaggacugggacugucgucuccuuuggcugugcuguugcccucuaaauguacccugcuuuuucccaccuuuucuuucucuguucgcccucacugugccuugucccagcauucucagacaccauccacauugaaccccacaaugccagccucugagcggacaguggccugggucuccaacaugccucaccugucggcugacaucgagagugcccacaucgagcgggaagaguacaagcucaaggaguacucaaaaucgauggaugagagccggcuggauaggguacgaugggcucuaccagcuccaagccccaguguuuccuuuuacccacaggggagaucucuagucacuuccaagggaaaccuccagggucaguuauggugguaagaaaaggcaaagaccugaucaccucuugagaagccuuccguccaucuggggagaccagauacacacaguuguuaaaagucacuuucaacucuauuuuguagguuauauauaucauagacuaucuggggaucaucuauuuuaggcuuaccuccauguucuuccccaggaggaacauaagcccuggcuccugugacugcuuaggaaaggaaauguuacuuuacuggcaguaggagcuaauaaauuggauggggauggaggggguugcagcuauauuacaagugaugucuggccuacccagucacugucccaugggcauaagugacagucagugggcagggaaugcaugugguaaaguaguauguaucagucaugugugaaaagaccauccagacccucacuugguggaggcugagggcaaagggcaccaagagcucuggggcuaacacagauaacuuagcagaaaguuacuugaggaagcuguuguuccuagggccugaggaagagggcggcugcaggauuaggucauauauaaagaacauaugauccuaacacggggaaguggucuuugagcauaggaaauguugggacugacucagaugggcuugaccagcaaauuuaaugagaauuaaacccuaauauuagccccaaggcagccaccguaggaaguuaauucacaucucuccucugcauguagaaggguuggugauauauguauguauccucuucagagaaugaggaaauagucuuuugaaucauuuuuuuuuucugugcuucagaugaggaaaccuuguugagaaaggcuguagacuagcacuauccaauauaacuuucugcagugaugaaauguucuguaaucuguaguguucacaugugucuaguugugauucaggaacugaauuuuuagaucuauuuaauuuuaauuuuguaauuuuuuugagacagggucuugcucugucacccaggcuggagugcaguggugcaaacauggcucgaggcaaccuccgccuccugggcucaagacauccucccaccucagcccccugaguagcuaggacuacagggucgugcuaccaugccuggcuaguuuuuuuucuuuuuuuuuuuuuuuuuuuuuuuuguagagacgggguuuugccauguugcccaggcuggucuagaacuugugagcucaagugaucuaccugccucagccuuccaaagugcugggauuacagguguugagccacugugccuggccuaaauuuuaaauagcuacaugugggcugguggcuaccauauuagacagcacagcuguagacucuagagccaauagggcagauaaaaugacucuucugagcucuuccagcucuggaauuccuagauucucagccuagaauucacuuguagaccuccuauccuuggcaccuugacagagccaaggagagggucacauggaggacagcaccugccuuucccccgucaauugccuuuucuuccuaugucuccagcauguguucuggggccuggcuuagggcugaagagucacccuauuuuuaauuucugagcacaguuacucaagguguguuugugaguguagguuucugugugggucuucaugaggggccauacauagaccucagggugugggagucugugaccuugcuccauuuugagggaaccucagcaccauggcagggucuucucaaaagcagguguguggauaugauccacaggcagggaagggguuggggaaggcagcuggaugucccucaacaugcaguggcugugcuuggcagacagggauggaggcuggguggugggcuugggguggggcgccccucauagugcggggucgugugcccggcgggcaggugaaggaguacgaggaggagauucacucacugaaagagcggcugcacauguccaaccggaagcuggaagaguaugagcggaggcugcugucccaggaagaacaaaccagcaaaauccugaugcaguaucaggcccgacuggagcagagugagaagaggcuaaggcagcagcaggcagagaaggauucccagaucaagagcaucauuggcaggugaggggcggccuggggaggggguugugagggagagccugaggcuggagagagcaagugggcgagcuacuccucugacucccauccccaaacucaggagcccaccaggagagcccaccacucuccuccccaggaagccacccacucacucaucaccagauggagagaaaccccaaccugcuuagugcauuaaauaucucuuuaccaaacccugaccucucuucugauagaguagcuucggaagcccuuggaaaauguaccuguuccuguccaaccaucacugcauuugcauuuacccuaggccagagcuccccacuaguuauucucaacuuaaccugugauguucacuccaaaccuaagcagggcucccuagccagaguaggcccugcccuuccuggguggacccucccucucuagccuuggaaagguguucuguuagaaagggucuuuuagccuguguauguuuucagcugcuccagcaaguccugggcuccaaagaggguauccucagcaaagaggucaauuaucuucagagugguggggucggggugggggggacccugggcgcacuccaaccagagccaccuccauuuugauccauucuaaauguauuuuauguaagauuuaauuagaagaaaagggcuucuugaaauauuuuuugaaaaccacugcucuaauugauauccuuuaugauaaaucaccucgaggaucuucacagugaggugacaugggggaugcagaagccagguccucagccauggaaggucuggggaaggggcacugcuguccugauugggacgauggaggccuggaggugucuggaugguagaagucuuugaggcacagaaagcugccuuagcagggagguguaaggguuccugggaggaagguggagagcaugauccugaggaacagggagucuugcaucacggcaauggagggacucugauucuaagggauaaggaugccugagguuuuuccagagagcuaugggguuccaugggcaggcucugagccugugcccgccacuaaccccacugaagcccgucccuucaggcugaugcugguggaggaggagcugcgccgggaccaccccgccauggcugagccgcugccagaacccaagaagaggcugcucgacgcucagguggaaauuacaaugucauuuaucuucuccgugucccauccccauccaucccacugucuuucgugcacucacuacaccagccaccuagccccaucaccaucugucucucauagucugcuguuuguccacuggcugcuccuggcagcccccuagugaccccaucuucaucccaucgucugugccuuugucacuccuggcagcgucagcccaacuccugugccuucccauccagucuucccacuccucucugcaucucaggaccuucucuaccagaaccuuggucuuucugccccuagaccccaccuaguuccaagaaccccugccccuucuuugcucacuccuauucaagccacguuguucagcuuccucugcgcucuugggccagagggcuagaagcugcuguuuucuggaauagagcacagggcaguaugaucuguaguuucuccaggcccuggccgguacccugaaaacuuggggacccaucaccucuguucucuuggcucccuaauuuuccugucuccuuggcagcuccugcauagcuuccucuuccugacucuucagaucuugaaggccuuccauccuguaaccucccuuugcccucaguauuuaaguccagccucccucuggccucccucccacucuggcccucagaccuucccagcugccugcugcccagccucucuucucacaagccagcuucuaggaccucccuucugcacccuuaccccuugcuuucccaaaauucugcucauuuuccuacccauacuccucuuugcucugacugcuaggcuccccccgccugccauccccccaccaaggcuccugaccccaugaccccacucucucccacugcagcuccucaucagguaauucuccugguuccgcuuuggccacgggcggaggacacagggggaggugacuccggaccacugcagguuggucgugaagcccacucccuccaacaccuccggagccucuccccucucacugcugcccuccacacccagagaaccuccacagacuccagcccuccgacaccugcacagauccaucucccaagacaccacccaaagagagcauuugcugcugcuucccagaacuguccaacaauaccuuagcaacaccaagaguugggcccuagaugggcccagcacauucacaggucacacccacuucccugcaaaacccacccccucccagccuccuccugacucuaagcccuccucuuccucuaccucuccaguguaugucugucaccccccauuucaccagagcguccuuaggggcuggggguggguuuguuaaugggguggaggcaaugauggguuggaggaucuuggcuauaggggcugugcugacugcagcagguagguuggguuucccucuuccuucccuaaucuugguucucuacccuccuuuccacuccucaccugauucucucucuuccuccuccuuauaucugugaggcagaaggcaucugaagcucauauuagcccccauugggugggaauuaggaguggguaguuaacucagggagacuugagauacccuggaaaaaaugcuauugagauguccugacauuaggcaggguggauggaacaagaaggagcaagaaaggaaccucaggcagauguuaggacauggacuugaucauguggccugggaguuuagaaauggggagagacauccuccuagaucagaucgugggcucaguaggcauguugauucccagggagaggugccaggaacagcaugguaaagaauguacucuucacagcucacauccccagguugcugaugccacucacucccccucuccugccaucgaguggccuugccggacacaucacccuaccuaaaaagccaguaaaugagaaccugucagcuauagccaucauuucugagaugcgauuuucuuugggauugagcugcagugggcaguggcuccuuacacuguaauuuuaauucucugccugcccagccucucugucaaaguagcuggugaucuauaaagaugcuaaaaggcaccaggggacuuugccauuuaaaggacuccugcagugaauucuuuuguaaaaugaauaauggcacccuaauuuauccacuuucuaaauuuggguccauggggguguccagggcaugcuuaugugcugucaccagcagacaaacagagggaauggaaucuggggguuccuucccugcucucccgccauacucaggauacccuaccauaagugauuuccucucacugacuugcagaaaaugugugagauacccagcaagcuaagaaggcaguuuugcuggguaucucauacccaaggcugggguuugggugaucugagagguuagcuccuugauccuaggauggaagggagagcuuauauagaagcuuuuacuuggaagguuuuguauccuaaggucagacauagcuauauuaccaagccuaaaugccauguggcccaggaaauaauuuggacauuuguucuaaaccacuugugguagguauuggucucucugcaacucagccauuaauuagaaauuaguuuugagccugaauuuuaaaaagccaaguguugcccccagcccacacacacacacacggacauguacaguacaaaccccagauaauuacaacagccaaagagagaaggaagugaauuucccaaccagaagcguagggaaauucagauggcuuucuuuucucccagcagaggaacagaaggcggagcuaagggcaggaaccaggaguuggucaaggagcuauaggaggugaugagaguagaaccagggguaggagcuggucugguaccccucacccucuaauugggagcccagggagaaggacugaaaagaagaugggaguggaaaagaauaaagccaguuucugcuucccagggaugcagagauuggggcaugcugugucugcagaagcuccuagucauuuccgccauaauugugagagagaggggcagcccucccacaagauuuuucccuucccauaucacuucccugaauccccuuccuuuccccccaguacaguuaaaccucucucuaauuuggaauguuauauuugagaagauggccacugugaauaagugacaaacggaaugacagugucuauuuaaugaaaugcaugucuucaaaauauauacagaacucgaugaacaaggcuuuuuccacuccucagggagcaugcauuaaugaauagauaggauucaaaagucuguuuucugguauggguuaaauauccccuccuacagacauauuuccaccacuaauuugcuuaguacaccuuuucuucacagauaaaggaaaaugcaagcucaguuuuucuucagauuaugaagaaauuccaaauccacagggguuuggauuaaugagguuuugcuguacugccuccccuuauuccucaacaugaaguucccaccucggauuggggaugggugggaggggguuucaagaggaggagggugggaugggcaaggaauauacacaggugaagccagagaaggguuagguugggggugcggugggaacuugcuguuuugaucugguuuccuggugugacacucuggguuaaaggcuugaaggccccuguuaggagucuaggggugagauucucuucucucugaucccagaggacguuaacuucuacugcaggugagaaacaaaauaggaggaugguggggacuguccugggaggagggggugguccauggcuuguggugugggcuggcuauaggggaggccacugcuaggggacuggcauccaggcccccuugaagcgucucaauaaguccgcgcucuccuuuuuggugucuugcaggagaggcagcuuccccccuuggguccaacaaacccgcgugugacgcuggccccaccguggaauggccuggcccccccagccccaccacccccaccccggcugcagauuacggagaacggcgaguuccgaaacaccgcagaccacuagcccacccagcaucagagaccuucucuuccuuuccugugcaccccacccuguaacagcaccaaccaccaggauuggacaucaccgaggaacagcgggauugccuccccgaaugccucccugggaggcacacugauugcccacccccaccacugcaccauuuccaggagggagaguggggacccucagccgcccccuuuuccuucccauuggggugcugcccucucuuugacccccagggacccuugccccaggacaccgccuaccccguacagaccccuucacuccggggugcuauccccauccucugccucaucguuccccugagcacugggggacagacccucacccccacccuggggguguggcaccuccaaacuuucaacuucagggugauuuuuuuagcaguaaccagagcugacaaucuaacuccccuccaccgccccauuuuggccuccccugccccccuuguuauggggaggggaccccgggugagggggcccuauuaccccuugauuucucaggagcgucugggggggcucagcacgcacaaacuccuucuccuucuaccacucuuaaauuuacucccuccccacccagaacccagaugggguggagggggccaccggggcagggagggggcggcaaggggggaaugggaguugucuccccuucuccccacaccugaucugcucucggcuggucccagagcggggugagggggcuuaugccccccccucccccaguguguugggugggguggaauugagguuagggugaggggucaggguuuaggaggguguguauguugggaggacaggcuaguugaucuguccuacucugacacacaguccccucugccccuuccuucucucuucuuggucucuacucccagggggaggggggaacuuacucuaggaaaagccaugucucucucccccaggguggggggaccuguguuggaggagggguguuggggggcccccuuccaugacucuguccccugggggagguaggacagggcugggcuucccucucauccucccccucccaaucuccuuccaccucccucccucccgccagcuccacgauuuuucgguguuucucuguacauaguuuucuggcgggauaggggagguaggauggaugggguuugggguggguaggccaugggaggggagaagccccuccuuggcacccccucuucccugacugcuguccccuacccagccuugcccccuucauccuuuugcguuugguauugagacucuccuagacucuacuccucuuucuuuuguauggacaguuccccuucagucccaucccccuacacauacacccagccggggccaaauuuauacuuauauaaaaguuguaaauaugugaaauuuuaucccugugcccuuuccccaccucaggcccuaccccuggacccuccccaaccuuccuucucucuucuuuggcuguuguaauuaucugggguuuguacuguacauauccggggugugugugugugggcugggggcaacccuucuguacagagcuuccuggcccccuccccccccgccccucugcuucccuccccacccaccaccucaaggguagggaguugcucuuccuaccuguuuuauuuuguuuucucguucucccuccccaccccacucccagccuuaucuauccccccucacuguccccuuuucuccacucccagccccauuuccuuuuuuucuggaguguguggugaaacagaaaaaaacauguuuaauaaacggagauuguucuuuua

SEQ ID NO: 10 - RNA, 18 nt, Artificial Sequence
  Description of Artificial Sequence: Synthetic oligonucleotide
aaagggcauucacaacca

SEQ ID NO: 11 - RNA, 18 nt, Artificial Sequence
  Description of Artificial Sequence: Synthetic oligonucleotide
uccuaaaagggcauucac

SEQ ID NO: 12 - RNA, 18 nt, Artificial Sequence
  Description of Artificial Sequence: Synthetic oligonucleotide
auugcuccuaaaagggca

SEQ ID NO: 13 - RNA, 18 nt, Artificial Sequence
  Description of Artificial Sequence: Synthetic oligonucleotide
auggaauugcuccuaaaa

SEQ ID NO: 14 - RNA, 18 nt, Artificial Sequence
  Description of Artificial Sequence: Synthetic oligonucleotide
gauggauggaauugcucc

SEQ ID NO: 15 - RNA, 18 nt, Artificial Sequence
  Description of Artificial Sequence: Synthetic oligonucleotide
uucaugauggauggaauu

SEQ ID NO: 16 - RNA, 18 nt, Artificial Sequence
  Description of Artificial Sequence: Synthetic oligonucleotide
gcacauucaugauggaug

SEQ ID NO: 17 - RNA, 18 nt, Artificial Sequence
  Description of Artificial Sequence: Synthetic oligonucleotide
cagaagcacauucaugau

SEQ ID NO: 18 - RNA, 18 nt, Artificial Sequence
  Description of Artificial Sequence: Synthetic oligonucleotide
caaaccagaagcacauuc

SEQ ID NO: 19 - RNA, 18 nt, Artificial Sequence
  Description of Artificial Sequence: Synthetic oligonucleotide
uaagacaaaccagaagca

SEQ ID NO: 20 - RNA, 18 nt, Artificial Sequence
  Description of Artificial Sequence: Synthetic oligonucleotide
gaauauaagacaaaccag

SEQ ID NO: 21 - RNA, 18 nt, Artificial Sequence
  Description of Artificial Sequence: Synthetic oligonucleotide
agccagaauauaagacaa

SEQ ID NO: 22 - RNA, 18 nt, Artificial Sequence
  Description of Artificial Sequence: Synthetic oligonucleotide
aaauuagccagaauauaa

SEQ ID NO: 23 - RNA, 18 nt, Artificial Sequence
  Description of Artificial Sequence: Synthetic oligonucleotide
gcugaaaauuagccagaa

SEQ ID NO: 24 - RNA, 18 nt, Artificial Sequence
  Description of Artificial Sequence: Synthetic oligonucleotide
augaugcugaaaauuagc

SEQ ID NO: 25 - RNA, 18 nt, Artificial Sequence
  Description of Artificial Sequence: Synthetic oligonucleotide
cgcccaugaugcugaaaa

SEQ ID NO: 26 - RNA, 18 nt, Artificial Sequence
  Description of Artificial Sequence: Synthetic oligonucleotide
auuuacgcccaugaugcu

SEQ ID NO: 27 - RNA, 18 nt, Artificial Sequence
  Description of Artificial Sequence: Synthetic oligonucleotide
aacaaauuuacgcccaug

SEQ ID NO: 28 - RNA, 18 nt, Artificial Sequence
  Description of Artificial Sequence: Synthetic oligonucleotide
cagcaaacaaauuuacgc

SEQ ID NO: 29 - RNA, 18 nt, Artificial Sequence
  Description of Artificial Sequence: Synthetic oligonucleotide
uuugccagcaaacaaauu

SEQ ID NO: 30 - RNA, 18 nt, Artificial Sequence
  Description of Artificial Sequence: Synthetic oligonucleotide
uagaauuugccagcaaac

SEQ ID NO: 31 - RNA, 18 nt, Artificial Sequence
  Description of Artificial Sequence: Synthetic oligonucleotide
agugguagaauuugccag

SEQ ID NO: 32 - RNA, 18 nt, Artificial Sequence
  Description of Artificial Sequence: Synthetic oligonucleotide
aauacagugguagaauuu

SEQ ID NO: 33 - RNA, 18 nt, Artificial Sequence
  Description of Artificial Sequence: Synthetic oligonucleotide
guguuaauacagugguag

SEQ ID NO: 34 - RNA, 18 nt, Artificial Sequence
  Description of Artificial Sequence: Synthetic oligonucleotide
uugugguguuaauacagu

SEQ ID NO: 35 - RNA, 18 nt, Artificial Sequence
  Description of Artificial Sequence: Synthetic oligonucleotide
accaguugugguguuaau

SEQ ID NO: 36 - RNA, 18 nt, Artificial Sequence
  Description of Artificial Sequence: Synthetic oligonucleotide
cugucaccaguuguggug

SEQ ID NO: 37 - RNA, 18 nt, Artificial Sequence
  Description of Artificial Sequence: Synthetic oligonucleotide
caaaccugucaccaguug

SEQ ID NO: 38 - RNA, 18 nt, Artificial Sequence
  Description of Artificial Sequence: Synthetic oligonucleotide
gaugucaaaccugucacc

SEQ ID NO: 39 - RNA, 18 nt, Artificial Sequence
  Description of Artificial Sequence: Synthetic oligonucleotide
ucuucgaugucaaaccug

SEQ ID NO: 40 - RNA, 18 nt, Artificial Sequence
  Description of Artificial Sequence: Synthetic oligonucleotide
ucacgucuucgaugucaa

SEQ ID NO: 41 - RNA, 18 nt, Artificial Sequence
  Description of Artificial Sequence: Synthetic oligonucleotide
auuauucacgucuucgau

SEQ ID NO: 42 - RNA, 18 nt, Artificial Sequence
  Description of Artificial Sequence: Synthetic oligonucleotide
guaugauuauucacgucu

SEQ ID NO: 43 - RNA, 18 nt, Artificial Sequence
  Description of Artificial Sequence: Synthetic oligonucleotide
aaucaguaugauuauuca

SEQ ID NO: 44 - RNA, 18 nt, Artificial Sequence
  Description of Artificial Sequence: Synthetic oligonucleotide
uaggcaaucaguaugauu

SEQ ID NO: 45 - RNA, 18 nt, Artificial Sequence
  Description of Artificial Sequence: Synthetic oligonucleotide
aguuuuaggcaaucagua

SEQ ID NO: 46 - RNA, 18 nt, Artificial Sequence
  Description of Artificial Sequence: Synthetic oligonucleotide
cuauuaguuuuaggcaau

SEQ ID NO: 47 - RNA, 18 nt, Artificial Sequence
  Description of Artificial Sequence: Synthetic oligonucleotide
ucuuucuauuaguuuuag

SEQ ID NO: 48 - RNA, 18 nt, Artificial Sequence
  Description of Artificial Sequence: Synthetic oligonucleotide
ucauuucuuucuauuagu

SEQ ID NO: 49 - RNA, 18 nt, Artificial Sequence
  Description of Artificial Sequence: Synthetic oligonucleotide
cagucucauuucuuucua

SEQ ID NO: 50 - RNA, 18 nt, Artificial Sequence
  Description of Artificial Sequence: Synthetic oligonucleotide
ucgagcagucucauuucu

SEQ ID NO: 51 - RNA, 18 nt, Artificial Sequence
  Description of Artificial Sequence: Synthetic oligonucleotide
uuccaucgagcagucuca

SEQ ID NO: 52 - RNA, 18 nt, Artificial Sequence
  Description of Artificial Sequence: Synthetic oligonucleotide
cauuuuuccaucgagcag

SEQ ID NO: 53 - RNA, 18 nt, Artificial Sequence
  Description of Artificial Sequence: Synthetic oligonucleotide
uuucacauuuuuccaucg

SEQ ID NO: 54 - RNA, 18 nt, Artificial Sequence
  Description of Artificial Sequence: Synthetic oligonucleotide
uuuacuuucacauuuuuc

SEQ ID NO: 55 - RNA, 18 nt, Artificial Sequence
  Description of Artificial Sequence: Synthetic oligonucleotide
caaaguuuacuuucacau

SEQ ID NO: 56 - RNA, 18 nt, Artificial Sequence
  Description of Artificial Sequence: Synthetic oligonucleotide
auuaucaaaguuuacuuu

SEQ ID NO: 57 - RNA, 18 nt, Artificial Sequence
  Description of Artificial Sequence: Synthetic oligonucleotide
ccuacauuaucaaaguuu

SEQ ID NO: 58 - RNA, 18 nt, Artificial Sequence
  Description of Artificial Sequence: Synthetic oligonucleotide
caaauccuacauuaucaa

SEQ ID NO: 59 - RNA, 18 nt, Artificial Sequence
  Description of Artificial Sequence: Synthetic oligonucleotide
auacccaaauccuacauu

SEQ ID NO: 60 - RNA, 18 nt, Artificial Sequence
  Description of Artificial Sequence: Synthetic oligonucleotide
gagagauacccaaauccu

SEQ ID NO: 61 - RNA, 18 nt, Artificial Sequence
  Description of Artificial Sequence: Synthetic oligonucleotide
gcaaagagagauacccaa

SEQ ID NO: 62 - RNA, 18 nt, Artificial Sequence
  Description of Artificial Sequence: Synthetic oligonucleotide
uugaagcaaagagagaua

SEQ ID NO: 63 - RNA, 18 nt, Artificial Sequence
  Description of Artificial Sequence: Synthetic oligonucleotide
cagagaaaauaguguuca

SEQ ID NO: 64 - RNA, 18 nt, Artificial Sequence
  Description of Artificial Sequence: Synthetic oligonucleotide
auauucagagaaaauagu

SEQ ID NO: 65 - RNA, 18 nt, Artificial Sequence
  Description of Artificial Sequence: Synthetic oligonucleotide
uaaaaauauucagagaaa

SEQ ID NO: 66 - RNA, 18 nt, Artificial Sequence
  Description of Artificial Sequence: Synthetic oligonucleotide
aacaauaaaaauauucag

SEQ ID NO: 67 - RNA, 18 nt, Artificial Sequence
  Description of Artificial Sequence: Synthetic oligonucleotide
uuccaaacaauaaaaaua

SEQ ID NO: 68 - RNA, 18 nt, Artificial Sequence
  Description of Artificial Sequence: Synthetic oligonucleotide
uauuauuccaaacaauaa

SEQ ID NO: 69 - RNA, 18 nt, Artificial Sequence
  Description of Artificial Sequence: Synthetic oligonucleotide
uuuguuauuauuccaaac

SEQ ID NO: 70 - RNA, 18 nt, Artificial Sequence
  Description of Artificial Sequence: Synthetic oligonucleotide
auuauuuuguuauuauuc

SEQ ID NO: 71 - RNA, 18 nt, Artificial Sequence
  Description of Artificial Sequence: Synthetic oligonucleotide
augucauuauuuuguuau

SEQ ID NO: 72 - RNA, 18 nt, Artificial Sequence
  Description of Artificial Sequence: Synthetic oligonucleotide
gauguaugucauuauuuu

SEQ ID NO: 73 - RNA, 18 nt, Artificial Sequence
  Description of Artificial Sequence: Synthetic oligonucleotide
uaauagauguaugucauu

SEQ ID NO: 74 - RNA, 18 nt, Artificial Sequence
  Description of Artificial Sequence: Synthetic oligonucleotide
cuaaauaauagauguaug

SEQ ID NO: 75 - RNA, 18 nt, Artificial Sequence
  Description of Artificial Sequence: Synthetic oligonucleotide
aggaacuaaauaauagau

SEQ ID NO: 76 - RNA, 18 nt, Artificial Sequence
  Description of Artificial Sequence: Synthetic oligonucleotide
uucuuaggaacuaaauaa

SEQ ID NO: 77 - RNA, 18 nt, Artificial Sequence
  Description of Artificial Sequence: Synthetic oligonucleotide
acuuuuucuuaggaacua

SEQ ID NO: 78 - RNA, 18 nt, Artificial Sequence
  Description of Artificial Sequence: Synthetic oligonucleotide
uauauacuuuuucuuagg

SEQ ID NO: 79 - RNA, 18 nt, Artificial Sequence
  Description of Artificial Sequence: Synthetic oligonucleotide
agaaauauauacuuuuuc

SEQ ID NO: 80 - RNA, 18 nt, Artificial Sequence
  Description of Artificial Sequence: Synthetic oligonucleotide
uagaaagaaauauauacu

SEQ ID NO: 81 - RNA, 18 nt, Artificial Sequence
  Description of Artificial Sequence: Synthetic oligonucleotide
uuaaauagaaagaaauau

SEQ ID NO: 82 - RNA, 18 nt, Artificial Sequence
  Description of Artificial Sequence: Synthetic oligonucleotide
auuuuuuaaauagaaaga

SEQ ID NO: 83 - RNA, 18 nt, Artificial Sequence
  Description of Artificial Sequence: Synthetic oligonucleotide
uugaaauuuuuuaaauag

SEQ ID NO: 84 - RNA, 18 nt, Artificial Sequence
  Description of Artificial Sequence: Synthetic oligonucleotide
acaaauugaaauuuuuua

SEQ ID NO: 85 - RNA, 18 nt, Artificial Sequence
  Description of Artificial Sequence: Synthetic oligonucleotide
uacuaacaaauugaaauu

SEQ ID NO: 86 - RNA, 18 nt, Artificial Sequence
  Description of Artificial Sequence: Synthetic oligonucleotide
acuuguacuaacaaauug

SEQ ID NO: 87 - RNA, 18 nt, Artificial Sequence
  Description of Artificial Sequence: Synthetic oligonucleotide
cauaaacuuguacuaaca

SEQ ID NO: 88 - RNA, 18 nt, Artificial Sequence
  Description of Artificial Sequence: Synthetic oligonucleotide
gggcucauaaacuuguac

SEQ ID NO: 89 - RNA, 18 nt, Artificial Sequence
  Description of Artificial Sequence: Synthetic oligonucleotide
caucugggcucauaaacu

SEQ ID NO: 90 - RNA, 18 nt, Artificial Sequence
  Description of Artificial Sequence: Synthetic oligonucleotide
ucacccaucugggcucau

SEQ ID NO: 91 - RNA, 18 nt, Artificial Sequence
  Description of Artificial Sequence: Synthetic oligonucleotide
aguuuucacccaucuggg

SEQ ID NO: 92 - RNA, 18 nt, Artificial Sequence
  Description of Artificial Sequence: Synthetic oligonucleotide
aauaaaguuuucacccau

SEQ ID NO: 93 - RNA, 18 nt, Artificial Sequence
  Description of Artificial Sequence: Synthetic oligonucleotide
cauguaauaaaguuuuca

SEQ ID NO: 94 - RNA, 18 nt, Artificial Sequence
  Description of Artificial Sequence: Synthetic oligonucleotide
ccuuacauguaauaaagu

SEQ ID NO: 95 - RNA, 18 nt, Artificial Sequence
  Description of Artificial Sequence: Synthetic oligonucleotide
gcaguccuuacauguaau

SEQ ID NO: 96 - RNA, 18 nt, Artificial Sequence
  Description of Artificial Sequence: Synthetic oligonucleotide
uaucugcaguccuuacau

SEQ ID NO: 97 - RNA, 18 nt, Artificial Sequence
  Description of Artificial Sequence: Synthetic oligonucleotide
gacuauaucugcaguccu

SEQ ID NO: 98 - RNA, 18 nt, Artificial Sequence
  Description of Artificial Sequence: Synthetic oligonucleotide
cuacugacuauaucugca

SEQ ID NO: 99 - RNA, 18 nt, Artificial Sequence
  Description of Artificial Sequence: Synthetic oligonucleotide
ggucacuacugacuauau

SEQ ID NO: 100 - RNA, 18 nt, Artificial Sequence
  Description of Artificial Sequence: Synthetic oligonucleotide
ggucuggucacuacugac

SEQ ID NO: 101 - RNA, 18 nt, Artificial Sequence
  Description of Artificial Sequence: Synthetic oligonucleotide
uguuuggucuggucacua

SEQ ID NO: 102 - RNA, 18 nt, Artificial Sequence
  Description of Artificial Sequence: Synthetic oligonucleotide
gucuuuguuuggucuggu

SEQ ID NO: 103 - RNA, 18 nt, Artificial Sequence
  Description of Artificial Sequence: Synthetic oligonucleotide
aagaggucuuuguuuggu

SEQ ID NO: 104 - RNA, 18 nt, Artificial Sequence
  Description of Artificial Sequence: Synthetic oligonucleotide
agacaaagaggucuuugu

SEQ ID NO: 105 - RNA, 18 nt, Artificial Sequence
  Description of Artificial Sequence: Synthetic oligonucleotide
aaaaaagacaaagagguc

SEQ ID NO: 106 - RNA, 18 nt, Artificial Sequence
  Description of Artificial Sequence: Synthetic oligonucleotide
acaagaaaaaagacaaag

SEQ ID NO: 107 - RNA, 18 nt, Artificial Sequence
  Description of Artificial Sequence: Synthetic oligonucleotide
aaaauacaagaaaaaaga

SEQ ID NO: 108 - RNA, 18 nt, Artificial Sequence
  Description of Artificial Sequence: Synthetic oligonucleotide
caaagaaaauacaagaaa

SEQ ID NO: 109 - RNA, 18 nt, Artificial Sequence
  Description of Artificial Sequence: Synthetic oligonucleotide
agaaacaaagaaaauaca

SEQ ID NO: 110 - RNA, 18 nt, Artificial Sequence
  Description of Artificial Sequence: Synthetic oligonucleotide
aauauagaaacaaagaaa

SEQ ID NO: 111 - RNA, 18 nt, Artificial Sequence
  Description of Artificial Sequence: Synthetic oligonucleotide
agagcaauauagaaacaa

SEQ ID NO: 112 - RNA, 18 nt, Artificial Sequence
  Description of Artificial Sequence: Synthetic oligonucleotide
uagaaagagcaauauaga

SEQ ID NO: 113 - RNA, 18 nt, Artificial Sequence
  Description of Artificial Sequence: Synthetic oligonucleotide
uuauauagaaagagcaau

SEQ ID NO: 114 - RNA, 18 nt, Artificial Sequence
  Description of Artificial Sequence: Synthetic oligonucleotide
cuuguuuauauagaaaga

SEQ ID NO: 115 - RNA, 18 nt, Artificial Sequence
  Description of Artificial Sequence: Synthetic oligonucleotide
auuuacuuguuuauauag

SEQ ID NO: 116 - RNA, 18 nt, Artificial Sequence
  Description of Artificial Sequence: Synthetic oligonucleotide
uauuaauuuacuuguuua

SEQ ID NO: 117 - RNA, 18 nt, Artificial Sequence
  Description of Artificial Sequence: Synthetic oligonucleotide
ugauuuauuaauuuacuu

SEQ ID NO: 118 - RNA, 18 nt, Artificial Sequence
  Description of Artificial Sequence: Synthetic oligonucleotide
guuacugauuuauuaauu

SEQ ID NO: 119 - RNA, 18 nt, Artificial Sequence
  Description of Artificial Sequence: Synthetic oligonucleotide
gcaaaguuacugauuuau

SEQ ID NO: 120 - RNA, 18 nt, Artificial Sequence
  Description of Artificial Sequence: Synthetic oligonucleotide
aaauggcaaaguuacuga

SEQ ID NO: 121 - RNA, 18 nt, Artificial Sequence
  Description of Artificial Sequence: Synthetic oligonucleotide
auaaaaaauggcaaaguu

SEQ ID NO: 122 - RNA, 18 nt, Artificial Sequence
  Description of Artificial Sequence: Synthetic oligonucleotide
ucacaauaaaaaauggca

SEQ ID NO: 123 - RNA, 18 nt, Artificial Sequence
  Description of Artificial Sequence: Synthetic oligonucleotide
ucuaaucacaauaaaaaa

SEQ ID NO: 124 - RNA, 18 nt, Artificial Sequence
  Description of Artificial Sequence: Synthetic oligonucleotide
agccuucuaaucacaaua

SEQ ID NO: 125 - RNA, 18 nt, Artificial Sequence
  Description of Artificial Sequence: Synthetic oligonucleotide
aaacaagccuucuaauca

SEQ ID NO: 126 - RNA, 18 nt, Artificial Sequence
  Description of Artificial Sequence: Synthetic oligonucleotide
cagggaaacaagccuucu

SEQ ID NO: 127 - RNA, 18 nt, Artificial Sequence
  Description of Artificial Sequence: Synthetic oligonucleotide
cugaucagggaaacaagc

SEQ ID NO: 128 - RNA, 18 nt, Artificial Sequence
  Description of Artificial Sequence: Synthetic oligonucleotide
gguagcugaucagggaaa

SEQ ID NO: 129 - RNA, 18 nt, Artificial Sequence
  Description of Artificial Sequence: Synthetic oligonucleotide
guuuugguagcugaucag

SEQ ID NO: 130 - RNA, 18 nt, Artificial Sequence
  Description of Artificial Sequence: Synthetic oligonucleotide
auuccguuuugguagcug

SEQ ID NO: 131 - RNA, 18 nt, Artificial Sequence
  Description of Artificial Sequence: Synthetic oligonucleotide
aguguauuccguuuuggu

SEQ ID NO: 132 - RNA, 18 nt, Artificial Sequence
  Description of Artificial Sequence: Synthetic oligonucleotide
uguuaaguguauuccguu

SEQ ID NO: 133 - RNA, 18 nt, Artificial Sequence
  Description of Artificial Sequence: Synthetic oligonucleotide
cuaucuguuaaguguauu

SEQ ID NO: 134 - RNA, 18 nt, Artificial Sequence
  Description of Artificial Sequence: Synthetic oligonucleotide
augaucuaucuguuaagu

SEQ ID NO: 135 - RNA, 18 nt, Artificial Sequence
  Description of Artificial Sequence: Synthetic oligonucleotide
ggaagaugaucuaucugu

SEQ ID NO: 136 - RNA, 18 nt, Artificial Sequence
  Description of Artificial Sequence: Synthetic oligonucleotide
guuuuggaagaugaucua

SEQ ID NO: 137 - RNA, 18 nt, Artificial Sequence
  Description of Artificial Sequence: Synthetic oligonucleotide
uauguguuuuggaagaug

SEQ ID NO: 138 - RNA, 18 nt, Artificial Sequence
  Description of Artificial Sequence: Synthetic oligonucleotide
aaguguauguguuuugga

SEQ ID NO: 139 - RNA, 18 nt, Artificial Sequence
  Description of Artificial Sequence: Synthetic oligonucleotide
guauuaaguguauguguu

SEQ ID NO: 140 - RNA, 18 nt, Artificial Sequence
  Description of Artificial Sequence: Synthetic oligonucleotide
uagguguauuaaguguau

SEQ ID NO: 141 - RNA, 18 nt, Artificial Sequence
  Description of Artificial Sequence: Synthetic oligonucleotide
ccaauuagguguauuaag

SEQ ID NO: 142 - RNA, 18 nt, Artificial Sequence
  Description of Artificial Sequence: Synthetic oligonucleotide
acaauccaauuaggugua

SEQ ID NO: 143 - RNA, 18 nt, Artificial Sequence
  Description of Artificial Sequence: Synthetic oligonucleotide
uaauuacaauccaauuag

SEQ ID NO: 144 - RNA, 18 nt, Artificial Sequence
  Description of Artificial Sequence: Synthetic oligonucleotide
ccaauuaauuacaaucca

SEQ ID NO: 145 - RNA, 18 nt, Artificial Sequence
  Description of Artificial Sequence: Synthetic oligonucleotide
cccuaccaauuaauuaca

SEQ ID NO: 146 - RNA, 18 nt, Artificial Sequence
  Description of Artificial Sequence: Synthetic oligonucleotide
uuaaucccuaccaauuaa

SEQ ID NO: 147 - RNA, 18 nt, Artificial Sequence
  Description of Artificial Sequence: Synthetic oligonucleotide
agcaguuaaucccuacca

SEQ ID NO: 148 - RNA, 18 nt, Artificial Sequence
  Description of Artificial Sequence: Synthetic oligonucleotide
ucagcagcaguuaauccc

SEQ ID NO: 149 - RNA, 18 nt, Artificial Sequence
  Description of Artificial Sequence: Synthetic oligonucleotide
agaacucagcagcaguua

SEQ ID NO: 150 - RNA, 18 nt, Artificial Sequence
  Description of Artificial Sequence: Synthetic oligonucleotide
auaauagaacucagcagc

SEQ ID NO: 151 - RNA, 18 nt, Artificial Sequence
  Description of Artificial Sequence: Synthetic oligonucleotide
uccaaauaauagaacuca

SEQ ID NO: 152 - RNA, 18 nt, Artificial Sequence
  Description of Artificial Sequence: Synthetic oligonucleotide
uuugauccaaauaauaga

SEQ ID NO: 153 - RNA, 18 nt, Artificial Sequence
  Description of Artificial Sequence: Synthetic oligonucleotide
caaacuuugauccaaaua

SEQ ID NO: 154 - RNA, 18 nt, Artificial Sequence
  Description of Artificial Sequence: Synthetic oligonucleotide
uuccccaaacuuugaucc

SEQ ID NO: 155 - RNA, 18 nt, Artificial Sequence
  Description of Artificial Sequence: Synthetic oligonucleotide
ugucauuccccaaacuuu

SEQ ID NO: 156 - RNA, 18 nt, Artificial Sequence
  Description of Artificial Sequence: Synthetic oligonucleotide
cuaaaugucauuccccaa

SEQ ID NO: 157 - RNA, 18 nt, Artificial Sequence
  Description of Artificial Sequence: Synthetic oligonucleotide
aaaaccuaaaugucauuc

SEQ ID NO: 158 - RNA, 18 nt, Artificial Sequence
  Description of Artificial Sequence: Synthetic oligonucleotide
auucuaaaaccuaaaugu

SEQ ID NO: 159 - RNA, 18 nt, Artificial Sequence
  Description of Artificial Sequence: Synthetic oligonucleotide
uucuaauucuaaaaccua

SEQ ID NO: 160 - RNA, 18 nt, Artificial Sequence
  Description of Artificial Sequence: Synthetic oligonucleotide
ccugguucuaauucuaaa

SEQ ID NO: 161 - RNA, 18 nt, Artificial Sequence
  Description of Artificial Sequence: Synthetic oligonucleotide
cuaugccugguucuaauu

SEQ ID NO: 162 - RNA, 18 nt, Artificial Sequence
  Description of Artificial Sequence: Synthetic oligonucleotide
uauccuuuuaagaauuuu

SEQ ID NO: 163 - RNA, 18 nt, Artificial Sequence
  Description of Artificial Sequence: Synthetic oligonucleotide
gcaacuauccuuuuaaga

SEQ ID NO: 164 - RNA, 18 nt, Artificial Sequence
  Description of Artificial Sequence: Synthetic oligonucleotide
ggguugcaacuauccuuu

SEQ ID NO: 165 - RNA, 18 nt, Artificial Sequence
  Description of Artificial Sequence: Synthetic oligonucleotide
aggcaggguugcaacuau

SEQ ID NO: 166 - RNA, 18 nt, Artificial Sequence
  Description of Artificial Sequence: Synthetic oligonucleotide
cauaaaggcaggguugca

SEQ ID NO: 167 - RNA, 18 nt, Artificial Sequence
  Description of Artificial Sequence: Synthetic oligonucleotide
ggauacauaaaggcaggg

SEQ ID NO: 168 - RNA, 18 nt, Artificial Sequence
  Description of Artificial Sequence: Synthetic oligonucleotide
uaccaggauacauaaagg

SEQ ID NO: 169 - RNA, 18 nt, Artificial Sequence
  Description of Artificial Sequence: Synthetic oligonucleotide
gauaguaccaggauacau

SEQ ID NO: 170 - RNA, 18 nt, Artificial Sequence
  Description of Artificial Sequence: Synthetic oligonucleotide
guaaggauaguaccagga

SEQ ID NO: 171 - RNA, 18 nt, Artificial Sequence
  Description of Artificial Sequence: Synthetic oligonucleotide
acaauguaaggauaguac

SEQ ID NO: 172 - RNA, 18 nt, Artificial Sequence
  Description of Artificial Sequence: Synthetic oligonucleotide
uuguaacaauguaaggau

SEQ ID NO: 173 - RNA, 18 nt, Artificial Sequence
  Description of Artificial Sequence: Synthetic oligonucleotide
cuuuauuguaacaaugua

SEQ ID NO: 174 - RNA, 18 nt, Artificial Sequence
  Description of Artificial Sequence: Synthetic oligonucleotide
uuucucuuuauuguaaca

SEQ ID NO: 175 - RNA, 18 nt, Artificial Sequence
  Description of Artificial Sequence: Synthetic oligonucleotide
uaagauuucucuuuauug

SEQ ID NO: 176 - RNA, 18 nt, Artificial Sequence
  Description of Artificial Sequence: Synthetic oligonucleotide
aaauuuaagauuucucuu

SEQ ID NO: 177 - RNA, 18 nt, Artificial Sequence
  Description of Artificial Sequence: Synthetic oligonucleotide
auugaaaauuuaagauuu

SEQ ID NO: 178 - RNA, 18 nt, Artificial Sequence
  Description of Artificial Sequence: Synthetic oligonucleotide
aagugauugaaaauuuaa

SEQ ID NO: 179 - RNA, 18 nt, Artificial Sequence
  Description of Artificial Sequence: Synthetic oligonucleotide
gaucaaagugauugaaaa

SEQ ID NO: 180 - RNA, 18 nt, Artificial Sequence
  Description of Artificial Sequence: Synthetic oligonucleotide
agggugaucaaagugauu

SEQ ID NO: 181 - RNA, 18 nt, Artificial Sequence
  Description of Artificial Sequence: Synthetic oligonucleotide
ucugcagggugaucaaag

SEQ ID NO: 182 - RNA, 18 nt, Artificial Sequence
  Description of Artificial Sequence: Synthetic oligonucleotide
auuuaucugcagggugau

SEQ ID NO: 183 - RNA, 18 nt, Artificial Sequence
  Description of Artificial Sequence: Synthetic oligonucleotide
cuaaaauuuaucugcagg

SEQ ID NO: 184 - RNA, 18 nt, Artificial Sequence
  Description of Artificial Sequence: Synthetic oligonucleotide
aucugcuaaaauuuaucu

SEQ ID NO: 185 - RNA, 18 nt, Artificial Sequence
  Description of Artificial Sequence: Synthetic oligonucleotide
ggaucaucugcuaaaauu

SEQ ID NO: 186 - RNA, 18 nt, Artificial Sequence
  Description of Artificial Sequence: Synthetic oligonucleotide
ucuaaggaucaucugcua

SEQ ID NO: 187 - RNA, 18 nt, Artificial Sequence
  Description of Artificial Sequence: Synthetic oligonucleotide
uuagaucuaaggaucauc

SEQ ID NO: 188 - RNA, 18 nt, Artificial Sequence
  Description of Artificial Sequence: Synthetic oligonucleotide
acaacuuagaucuaagga

SEQ ID NO: 189 - RNA, 18 nt, Artificial Sequence
  Description of Artificial Sequence: Synthetic oligonucleotide
uaauuacaacuuagaucu

SEQ ID NO: 190 - RNA, 18 nt, Artificial Sequence
  Description of Artificial Sequence: Synthetic oligonucleotide
ccaaauaauuacaacuua

SEQ ID NO: 191 - RNA, 18 nt, Artificial Sequence
  Description of Artificial Sequence: Synthetic oligonucleotide
aucagccaaauaauuaca

SEQ ID NO: 192 - RNA, 18 nt, Artificial Sequence
  Description of Artificial Sequence: Synthetic oligonucleotide
gcucuaucagccaaauaa

SEQ ID NO: 193 - RNA, 18 nt, Artificial Sequence
  Description of Artificial Sequence: Synthetic oligonucleotide
caauagcucuaucagcca

SEQ ID NO: 194 - RNA, 18 nt, Artificial Sequence
  Description of Artificial Sequence: Synthetic oligonucleotide
ugggucaauagcucuauc

SEQ ID NO: 195 - RNA, 18 nt, Artificial Sequence
  Description of Artificial Sequence: Synthetic oligonucleotide
acacaugggucaauagcu

SEQ ID NO: 196 - RNA, 18 nt, Artificial Sequence
  Description of Artificial Sequence: Synthetic oligonucleotide
ugccaacacaugggucaa

SEQ ID NO: 197 - RNA, 18 nt, Artificial Sequence
  Description of Artificial Sequence: Synthetic oligonucleotide
acaaaugccaacacaugg

SEQ ID NO: 198 - RNA, 18 nt, Artificial Sequence
  Description of Artificial Sequence: Synthetic oligonucleotide
gucuuacaaaugccaaca

SEQ ID NO: 199 - RNA, 18 nt, Artificial Sequence
  Description of Artificial Sequence: Synthetic oligonucleotide
agaaagucuuacaaaugc

SEQ ID NO: 200 - RNA, 18 nt, Artificial Sequence
  Description of Artificial Sequence: Synthetic oligonucleotide
uuuuuagaaagucuuaca

SEQ ID NO: 201 - RNA, 18 nt, Artificial Sequence
  Description of Artificial Sequence: Synthetic oligonucleotide
agcacuuuuuagaaaguc

SEQ ID NO: 202 - RNA, 18 nt, Artificial Sequence
  Description of Artificial Sequence: Synthetic oligonucleotide
gcuggagcacuuuuuaga

SEQ ID NO: 203 - RNA, 18 nt, Artificial Sequence
  Description of Artificial Sequence: Synthetic oligonucleotide
aauuugcuggagcacuuu

SEQ ID NO: 204 - RNA, 18 nt, Artificial Sequence
  Description of Artificial Sequence: Synthetic oligonucleotide
auuaaaauuugcuggagc

SEQ ID NO: 205 - RNA, 18 nt, Artificial Sequence
  Description of Artificial Sequence: Synthetic oligonucleotide
gcaguauuaaaauuugcu

SEQ ID NO: 206 - RNA, 18 nt, Artificial Sequence
  Description of Artificial Sequence: Synthetic oligonucleotide
uuaaagcaguauuaaaau

SEQ ID NO: 207 - RNA, 18 nt, Artificial Sequence
  Description of Artificial Sequence: Synthetic oligonucleotide
gauauuuaaagcaguauu

SEQ ID NO: 208 - RNA, 18 nt, Artificial Sequence
  Description of Artificial Sequence: Synthetic oligonucleotide
gucaugauauuuaaagca

SEQ ID NO: 209 - RNA, 18 nt, Artificial Sequence
  Description of Artificial Sequence: Synthetic oligonucleotide
auggugucaugauauuua

SEQ ID NO: 210 - RNA, 18 nt, Artificial Sequence
  Description of Artificial Sequence: Synthetic oligonucleotide
aguucauggugucaugau

SEQ ID NO: 211 - RNA, 18 nt, Artificial Sequence
  Description of Artificial Sequence: Synthetic oligonucleotide
uuuagaguucaugguguc

SEQ ID NO: 212 - RNA, 18 nt, Artificial Sequence
  Description of Artificial Sequence: Synthetic oligonucleotide
aauucuuuagaguucaug

SEQ ID NO: 213 - RNA, 18 nt, Artificial Sequence
  Description of Artificial Sequence: Synthetic oligonucleotide
uuuucaauucuuuagagu

SEQ ID NO: 214 - RNA, 18 nt, Artificial Sequence
  Description of Artificial Sequence: Synthetic oligonucleotide
agcacuuuucaauucuuu

SEQ ID NO: 215 - RNA, 18 nt, Artificial Sequence
  Description of Artificial Sequence: Synthetic oligonucleotide
ucacaagcacuuuucaau

SEQ ID NO: 216 - RNA, 18 nt, Artificial Sequence
  Description of Artificial Sequence: Synthetic oligonucleotide
ccaacucacaagcacuuu

SEQ ID NO: 217 - RNA, 18 nt, Artificial Sequence
  Description of Artificial Sequence: Synthetic oligonucleotide
gauaaccaacucacaagc

SEQ ID NO: 218 - RNA, 18 nt, Artificial Sequence
  Description of Artificial Sequence: Synthetic oligonucleotide
cccuugauaaccaacuca

SEQ ID NO: 219 - RNA, 18 nt, Artificial Sequence
  Description of Artificial Sequence: Synthetic oligonucleotide
uccuccccuugauaacca

SEQ ID NO: 220 - RNA, 18 nt, Artificial Sequence
  Description of Artificial Sequence: Synthetic oligonucleotide
auauauccuccccuugau

SEQ ID NO: 221 - RNA, 18 nt, Artificial Sequence
  Description of Artificial Sequence: Synthetic oligonucleotide
auuugauauauccucccc

SEQ ID NO: 222 - RNA, 18 nt, Artificial Sequence
  Description of Artificial Sequence: Synthetic oligonucleotide
uggccauuugauauaucc

SEQ ID NO: 223 - RNA, 18 nt, Artificial Sequence
  Description of Artificial Sequence: Synthetic oligonucleotide
caaaauggccauuugaua

SEQ ID NO: 224 - RNA, 18 nt, Artificial Sequence
  Description of Artificial Sequence: Synthetic oligonucleotide
uugaacaaaauggccauu

SEQ ID NO: 225 - RNA, 18 nt, Artificial Sequence
  Description of Artificial Sequence: Synthetic oligonucleotide
acauauugaacaaaaugg

SEQ ID NO: 226 - RNA, 18 nt, Artificial Sequence
  Description of Artificial Sequence: Synthetic oligonucleotide
agaacacauauugaacaa

SEQ ID NO: 227 - RNA, 18 nt, Artificial Sequence
  Description of Artificial Sequence: Synthetic oligonucleotide
uuucuagaacacauauug

SEQ ID NO: 228 - RNA, 18 nt, Artificial Sequence
  Description of Artificial Sequence: Synthetic oligonucleotide
uuucauuucuagaacaca

SEQ ID NO: 229 - RNA, 18 nt, Artificial Sequence
  Description of Artificial Sequence: Synthetic oligonucleotide
uggcuuuucauuucuaga

SEQ ID NO: 230 - RNA, 18 nt, Artificial Sequence
  Description of Artificial Sequence: Synthetic oligonucleotide
uaguauggcuuuucauuu

SEQ ID NO: 231 - RNA, 18 nt, Artificial Sequence
  Description of Artificial Sequence: Synthetic oligonucleotide
uauuuuaguauggcuuuu

SEQ ID NO: 232 - RNA, 18 nt, Artificial Sequence
  Description of Artificial Sequence: Synthetic oligonucleotide
gacaguauuuuaguaugg

SEQ ID NO: 233 - RNA, 18 nt, Artificial Sequence
  Description of Artificial Sequence: Synthetic oligonucleotide
accaagacaguauuuuag

SEQ ID NO: 234 - RNA, 18 nt, Artificial Sequence
  Description of Artificial Sequence: Synthetic oligonucleotide
uuuggaccaagacaguau

SEQ ID NO: 235 - RNA, 18 nt, Artificial Sequence
  Description of Artificial Sequence: Synthetic oligonucleotide
cagauuuuggaccaagac

SEQ ID NO: 236 - RNA, 18 nt, Artificial Sequence
  Description of Artificial Sequence: Synthetic oligonucleotide
uuacacagauuuuggacc

SEQ ID NO: 237 - RNA, 18 nt, Artificial Sequence
  Description of Artificial Sequence: Synthetic oligonucleotide
aaauuuuacacagauuuu

SEQ ID NO: 238 - RNA, 18 nt, Artificial Sequence
  Description of Artificial Sequence: Synthetic oligonucleotide
aaaacaaauuuuacacag

SEQ ID NO: 239 - RNA, 18 nt, Artificial Sequence
  Description of Artificial Sequence: Synthetic oligonucleotide
auuucaaaacaaauuuua

SEQ ID NO: 240 - RNA, 18 nt, Artificial Sequence
  Description of Artificial Sequence: Synthetic oligonucleotide
aagacauuucaaaacaaa

SEQ ID NO: 241 - RNA, 18 nt, Artificial Sequence
  Description of Artificial Sequence: Synthetic oligonucleotide
uuugaaagacauuucaaa

SEQ ID NO: 242 - RNA, 18 nt, Artificial Sequence
  Description of Artificial Sequence: Synthetic oligonucleotide
auauuuuugaaagacauu

SEQ ID NO: 243 - RNA, 18 nt, Artificial Sequence
  Description of Artificial Sequence: Synthetic oligonucleotide
agggaauauuuuugaaag

SEQ ID NO: 244 - RNA, 18 nt, Artificial Sequence
  Description of Artificial Sequence: Synthetic oligonucleotide
ucaaaagggaauauuuuu

SEQ ID NO: 245 - RNA, 18 nt, Artificial Sequence
  Description of Artificial Sequence: Synthetic oligonucleotide
aauuuucaaaagggaaua

SEQ ID NO: 246 - RNA, 18 nt, Artificial Sequence
  Description of Artificial Sequence: Synthetic oligonucleotide
gauauaauuuucaaaagg

SEQ ID NO: 247 - RNA, 18 nt, Artificial Sequence
  Description of Artificial Sequence: Synthetic oligonucleotide
uuacugauauaauuuuca

SEQ ID NO: 248 - RNA, 18 nt, Artificial Sequence
  Description of Artificial Sequence: Synthetic oligonucleotide
uauucuuacugauauaau

SEQ ID NO: 249 - RNA, 18 nt, Artificial Sequence
  Description of Artificial Sequence: Synthetic oligonucleotide
auaaauauucuuacugau

SEQ ID NO: 250 - RNA, 18 nt, Artificial Sequence
  Description of Artificial Sequence: Synthetic oligonucleotide
guuuaauaaauauucuua

SEQ ID NO: 251 - RNA, 18 nt, Artificial Sequence
  Description of Artificial Sequence: Synthetic oligonucleotide
cugauguuuaauaaauau

SEQ ID NO: 252 - RNA, 18 nt, Artificial Sequence
  Description of Artificial Sequence: Synthetic oligonucleotide
uagaccugauguuuaaua

SEQ ID NO: 253 - RNA, 18 nt, Artificial Sequence
  Description of Artificial Sequence: Synthetic oligonucleotide
uaauuuagaccugauguu

SEQ ID NO: 254 - RNA, 18 nt, Artificial Sequence
  Description of Artificial Sequence: Synthetic oligonucleotide
aaaaauaauuuagaccug

SEQ ID NO: 255 - RNA, 18 nt, Artificial Sequence
  Description of Artificial Sequence: Synthetic oligonucleotide
ggaguaaaaauaauuuag

SEQ ID NO: 256 - RNA, 18 nt, Artificial Sequence
  Description of Artificial Sequence: Synthetic oligonucleotide
acuuuggaguaaaaauaa

SEQ ID NO: 257 - RNA, 18 nt, Artificial Sequence
  Description of Artificial Sequence: Synthetic oligonucleotide
guuuuacuuuggaguaaa

SEQ ID NO: 258 - RNA, 18 nt, Artificial Sequence
  Description of Artificial Sequence: Synthetic oligonucleotide
ugcauguuuuacuuugga

SEQ ID NO: 259 - RNA, 18 nt, Artificial Sequence
  Description of Artificial Sequence: Synthetic oligonucleotide
uccauccuuugaaugugg

SEQ ID NO: 260 - RNA, 18 nt, Artificial Sequence
  Description of Artificial Sequence: Synthetic oligonucleotide
auccauccauccuuugaa

SEQ ID NO: 261 - RNA, 18 nt, Artificial Sequence
  Description of Artificial Sequence: Synthetic oligonucleotide
auuauauccauccauccu

SEQ ID NO: 262 - RNA, 18 nt, Artificial Sequence
  Description of Artificial Sequence: Synthetic oligonucleotide
cauacauuauauccaucc

SEQ ID NO: 263 - RNA, 18 nt, Artificial Sequence
  Description of Artificial Sequence: Synthetic oligonucleotide
ugcugcauacauuauauc

SEQ ID NO: 264 - RNA, 18 nt, Artificial Sequence
  Description of Artificial Sequence: Synthetic oligonucleotide
ucaacugcugcauacauu

SEQ ID NO: 265 - RNA, 18 nt, Artificial Sequence
  Description of Artificial Sequence: Synthetic oligonucleotide
uggaaucaacugcugcau

SEQ ID NO: 266 - RNA, 18 nt, Artificial Sequence
  Description of Artificial Sequence: Synthetic oligonucleotide
auuucuggaaucaacugc

SEQ ID NO: 267 - RNA, 18 nt, Artificial Sequence
  Description of Artificial Sequence: Synthetic oligonucleotide
aaagggcauucacaacca

SEQ ID NO: 268 - RNA, 18 nt, Artificial Sequence
  Description of Artificial Sequence: Synthetic oligonucleotide
uccuaaaagggcauucac

SEQ ID NO: 269 - RNA, 18 nt, Artificial Sequence
  Description of Artificial Sequence: Synthetic oligonucleotide
auugcuccuaaaagggca

SEQ ID NO: 270 - RNA, 18 nt, Artificial Sequence
  Description of Artificial Sequence: Synthetic oligonucleotide
auggaauugcuccuaaaa

SEQ ID NO: 271 - RNA, 18 nt, Artificial Sequence
  Description of Artificial Sequence: Synthetic oligonucleotide
gauggauggaauugcucc

SEQ ID NO: 272 - RNA, 18 nt, Artificial Sequence
  Description of Artificial Sequence: Synthetic oligonucleotide
uucaugauggauggaauu

SEQ ID NO: 273 - RNA, 18 nt, Artificial Sequence
  Description of Artificial Sequence: Synthetic oligonucleotide
gcacauucaugauggaug

SEQ ID NO: 274 - RNA, 18 nt, Artificial Sequence
  Description of Artificial Sequence: Synthetic oligonucleotide
cagaagcacauucaugau

SEQ ID NO: 275 - RNA, 18 nt, Artificial Sequence
  Description of Artificial Sequence: Synthetic oligonucleotide
caaaccagaagcacauuc

SEQ ID NO: 276 - RNA, 18 nt, Artificial Sequence
  Description of Artificial Sequence: Synthetic oligonucleotide
uaagacaaaccagaagca

SEQ ID NO: 277 - RNA, 18 nt, Artificial Sequence
  Description of Artificial Sequence: Synthetic oligonucleotide
gaauauaagacaaaccag

SEQ ID NO: 278 - RNA, 18 nt, Artificial Sequence
  Description of Artificial Sequence: Synthetic oligonucleotide
agccagaauauaagacaa

SEQ ID NO: 279 - RNA, 18 nt, Artificial Sequence
  Description of Artificial Sequence: Synthetic oligonucleotide
aaauuagccagaauauaa

SEQ ID NO: 280 - RNA, 18 nt, Artificial Sequence
  Description of Artificial Sequence: Synthetic oligonucleotide
gcugaaaauuagccagaa

SEQ ID NO: 281 - RNA, 18 nt, Artificial Sequence
  Description of Artificial Sequence: Synthetic oligonucleotide
augaugcugaaaauuagc

SEQ ID NO: 282 - RNA, 18 nt, Artificial Sequence
  Description of Artificial Sequence: Synthetic oligonucleotide
cgcccaugaugcugaaaa

SEQ ID NO: 283 - RNA, 18 nt, Artificial Sequence
  Description of Artificial Sequence: Synthetic oligonucleotide
auuuacgcccaugaugcu

SEQ ID NO: 284 - RNA, 18 nt, Artificial Sequence
  Description of Artificial Sequence: Synthetic oligonucleotide
aacaaauuuacgcccaug

SEQ ID NO: 285 - RNA, 18 nt, Artificial Sequence
  Description of Artificial Sequence: Synthetic oligonucleotide
cagcaaacaaauuuacgc

SEQ ID NO: 286 - RNA, 18 nt, Artificial Sequence
  Description of Artificial Sequence: Synthetic oligonucleotide
uuugccagcaaacaaauu

SEQ ID NO: 287 - RNA, 18 nt, Artificial Sequence
  Description of Artificial Sequence: Synthetic oligonucleotide
uagaauuugccagcaaac

SEQ ID NO: 288 - RNA, 18 nt, Artificial Sequence
  Description of Artificial Sequence: Synthetic oligonucleotide
agugguagaauuugccag

SEQ ID NO: 289 - RNA, 18 nt, Artificial Sequence
  Description of Artificial Sequence: Synthetic oligonucleotide
aauacagugguagaauuu

SEQ ID NO: 290 - RNA, 18 nt, Artificial Sequence
  Description of Artificial Sequence: Synthetic oligonucleotide
guguuaauacagugguag

SEQ ID NO: 291 - RNA, 18 nt, Artificial Sequence
  Description of Artificial Sequence: Synthetic oligonucleotide
uugugguguuaauacagu

SEQ ID NO: 292 - RNA, 18 nt, Artificial Sequence
  Description of Artificial Sequence: Synthetic oligonucleotide
accaguugugguguuaau

SEQ ID NO: 293 - RNA, 18 nt, Artificial Sequence
  Description of Artificial Sequence: Synthetic oligonucleotide
cugucaccaguuguggug

SEQ ID NO: 294 - RNA, 18 nt, Artificial Sequence
  Description of Artificial Sequence: Synthetic oligonucleotide
caaaccugucaccaguug

SEQ ID NO: 295 - RNA, 18 nt, Artificial Sequence
  Description of Artificial Sequence: Synthetic oligonucleotide
gaugucaaaccugucacc

SEQ ID NO: 296 - RNA, 18 nt, Artificial Sequence
  Description of Artificial Sequence: Synthetic oligonucleotide
ucuucgaugucaaaccug

SEQ ID NO: 297 - RNA, 18 nt, Artificial Sequence
  Description of Artificial Sequence: Synthetic oligonucleotide
ucacgucuucgaugucaa

SEQ ID NO: 298 - RNA, 18 nt, Artificial Sequence
  Description of Artificial Sequence: Synthetic oligonucleotide
auuauucacgucuucgau

SEQ ID NO: 299 - RNA, 18 nt, Artificial Sequence
  Description of Artificial Sequence: Synthetic oligonucleotide
guaugauuauucacgucu

SEQ ID NO: 300 - RNA, 18 nt, Artificial Sequence
  Description of Artificial Sequence: Synthetic oligonucleotide
aaucaguaugauuauuca

SEQ ID NO: 301 - RNA, 18 nt, Artificial Sequence
  Description of Artificial Sequence: Synthetic oligonucleotide
uaggcaaucaguaugauu

SEQ ID NO: 302 - RNA, 18 nt, Artificial Sequence
  Description of Artificial Sequence: Synthetic oligonucleotide
aguuuuaggcaaucagua

SEQ ID NO: 303 - RNA, 18 nt, Artificial Sequence
  Description of Artificial Sequence: Synthetic oligonucleotide
cuauuaguuuuaggcaau

SEQ ID NO: 304 - RNA, 18 nt, Artificial Sequence
  Description of Artificial Sequence: Synthetic oligonucleotide
ucuuucuauuaguuuuag

SEQ ID NO: 305 - RNA, 18 nt, Artificial Sequence
  Description of Artificial Sequence: Synthetic oligonucleotide
ucauuucuuucuauuagu

SEQ ID NO: 306 - RNA, 18 nt, Artificial Sequence
  Description of Artificial Sequence: Synthetic oligonucleotide
cagucucauuucuuucua

SEQ ID NO: 307 - RNA, 18 nt, Artificial Sequence
  Description of Artificial Sequence: Synthetic oligonucleotide
ucgagcagucucauuucu

SEQ ID NO: 308 - RNA, 18 nt, Artificial Sequence
  Description of Artificial Sequence: Synthetic oligonucleotide
uuccaucgagcagucuca

SEQ ID NO: 309 - RNA, 18 nt, Artificial Sequence
  Description of Artificial Sequence: Synthetic oligonucleotide
cauuuuuccaucgagcag

SEQ ID NO: 310 - RNA, 18 nt, Artificial Sequence
  Description of Artificial Sequence: Synthetic oligonucleotide
uuucacauuuuuccaucg

SEQ ID NO: 311 - RNA, 18 nt, Artificial Sequence
  Description of Artificial Sequence: Synthetic oligonucleotide
uuuacuuucacauuuuuc

SEQ ID NO: 312 - RNA, 18 nt, Artificial Sequence
  Description of Artificial Sequence: Synthetic oligonucleotide
caaaguuuacuuucacau

SEQ ID NO: 313 - RNA, 18 nt, Artificial Sequence
  Description of Artificial Sequence: Synthetic oligonucleotide
auuaucaaaguuuacuuu

SEQ ID NO: 314 - RNA, 18 nt, Artificial Sequence
  Description of Artificial Sequence: Synthetic oligonucleotide
ccuacauuaucaaaguuu

SEQ ID NO: 315 - RNA, 18 nt, Artificial Sequence
  Description of Artificial Sequence: Synthetic oligonucleotide
caaauccuacauuaucaa

SEQ ID NO: 316 - RNA, 18 nt, Artificial Sequence
  Description of Artificial Sequence: Synthetic oligonucleotide
auacccaaauccuacauu

SEQ ID NO: 317 - RNA, 18 nt, Artificial Sequence
  Description of Artificial Sequence: Synthetic oligonucleotide
gagagauacccaaauccu

SEQ ID NO: 318 - RNA, 18 nt, Artificial Sequence
  Description of Artificial Sequence: Synthetic oligonucleotide
gcaaagagagauacccaa

SEQ ID NO: 319 - RNA, 18 nt, Artificial Sequence
  Description of Artificial Sequence: Synthetic oligonucleotide
uugaagcaaagagagaua

SEQ ID NO: 320 - RNA, 18 nt, Artificial Sequence
  Description of Artificial Sequence: Synthetic oligonucleotide
cagagaaaauaguguuca

SEQ ID NO: 321 - RNA, 18 nt, Artificial Sequence
  Description of Artificial Sequence: Synthetic oligonucleotide
auauucagagaaaauagu

SEQ ID NO: 322 - RNA, 18 nt, Artificial Sequence
  Description of Artificial Sequence: Synthetic oligonucleotide
uaaaaauauucagagaaa

SEQ ID NO: 323 - RNA, 18 nt, Artificial Sequence
  Description of Artificial Sequence: Synthetic oligonucleotide
aacaauaaaaauauucag

SEQ ID NO: 324 - RNA, 18 nt, Artificial Sequence
  Description of Artificial Sequence: Synthetic oligonucleotide
uuccaaacaauaaaaaua

SEQ ID NO: 325 - RNA, 18 nt, Artificial Sequence
  Description of Artificial Sequence: Synthetic oligonucleotide
uauuauuccaaacaauaa

SEQ ID NO: 326 - RNA, 18 nt, Artificial Sequence
  Description of Artificial Sequence: Synthetic oligonucleotide
uuuguuauuauuccaaac

SEQ ID NO: 327 - RNA, 18 nt, Artificial Sequence
  Description of Artificial Sequence: Synthetic oligonucleotide
auuauuuuguuauuauuc

SEQ ID NO: 328 - RNA, 18 nt, Artificial Sequence
  Description of Artificial Sequence: Synthetic oligonucleotide
augucauuauuuuguuau

SEQ ID NO: 329 - RNA, 18 nt, Artificial Sequence
  Description of Artificial Sequence: Synthetic oligonucleotide
gauguaugucauuauuuu

SEQ ID NO: 330 - RNA, 18 nt, Artificial Sequence
  Description of Artificial Sequence: Synthetic oligonucleotide
uaauagauguaugucauu

SEQ ID NO: 331 - RNA, 18 nt, Artificial Sequence
  Description of Artificial Sequence: Synthetic oligonucleotide
cuaaauaauagauguaug

SEQ ID NO: 332 - RNA, 18 nt, Artificial Sequence
  Description of Artificial Sequence: Synthetic oligonucleotide
aggaacuaaauaauagau

SEQ ID NO: 333 - RNA, 18 nt, Artificial Sequence
  Description of Artificial Sequence: Synthetic oligonucleotide
uucuuaggaacuaaauaa

SEQ ID NO: 334 - RNA, 18 nt, Artificial Sequence
  Description of Artificial Sequence: Synthetic oligonucleotide
acuuuuucuuaggaacua

SEQ ID NO: 335 - RNA, 18 nt, Artificial Sequence
  Description of Artificial Sequence: Synthetic oligonucleotide
uauauacuuuuucuuagg

SEQ ID NO: 336 - RNA, 18 nt, Artificial Sequence
  Description of Artificial Sequence: Synthetic oligonucleotide
agaaauauauacuuuuuc

SEQ ID NO: 337 - RNA, 18 nt, Artificial Sequence
  Description of Artificial Sequence: Synthetic oligonucleotide
uagaaagaaauauauacu

SEQ ID NO: 338 - RNA, 18 nt, Artificial Sequence
  Description of Artificial Sequence: Synthetic oligonucleotide
uuaaauagaaagaaauau

SEQ ID NO: 339 - RNA, 18 nt, Artificial Sequence
  Description of Artificial Sequence: Synthetic oligonucleotide
auuuuuuaaauagaaaga

SEQ ID NO: 340 - RNA, 18 nt, Artificial Sequence
  Description of Artificial Sequence: Synthetic oligonucleotide
uugaaauuuuuuaaauag

SEQ ID NO: 341 - RNA, 18 nt, Artificial Sequence
  Description of Artificial Sequence: Synthetic oligonucleotide
acaaauugaaauuuuuua

SEQ ID NO: 342 - RNA, 18 nt, Artificial Sequence
  Description of Artificial Sequence: Synthetic oligonucleotide
uacuaacaaauugaaauu

SEQ ID NO: 343 - RNA, 18 nt, Artificial Sequence
  Description of Artificial Sequence: Synthetic oligonucleotide
acuuguacuaacaaauug

SEQ ID NO: 344 - RNA, 18 nt, Artificial Sequence
  Description of Artificial Sequence: Synthetic oligonucleotide
cauaaacuuguacuaaca

SEQ ID NO: 345 - RNA, 18 nt, Artificial Sequence
  Description of Artificial Sequence: Synthetic oligonucleotide
gggcucauaaacuuguac

SEQ ID NO: 346 - RNA, 18 nt, Artificial Sequence
  Description of Artificial Sequence: Synthetic oligonucleotide
caucugggcucauaaacu

SEQ ID NO: 347 - RNA, 18 nt, Artificial Sequence
  Description of Artificial Sequence: Synthetic oligonucleotide
ucacccaucugggcucau

SEQ ID NO: 348 - RNA, 18 nt, Artificial Sequence
  Description of Artificial Sequence: Synthetic oligonucleotide
aguuuucacccaucuggg

SEQ ID NO: 349 - RNA, 18 nt, Artificial Sequence
  Description of Artificial Sequence: Synthetic oligonucleotide
aauaaaguuuucacccau

SEQ ID NO: 350 - RNA, 18 nt, Artificial Sequence
  Description of Artificial Sequence: Synthetic oligonucleotide
cauguaauaaaguuuuca

SEQ ID NO: 351 - RNA, 18 nt, Artificial Sequence
  Description of Artificial Sequence: Synthetic oligonucleotide
ccuuacauguaauaaagu

SEQ ID NO: 352 - RNA, 18 nt, Artificial Sequence
  Description of Artificial Sequence: Synthetic oligonucleotide
gcaguccuuacauguaau

SEQ ID NO: 353 - RNA, 18 nt, Artificial Sequence
  Description of Artificial Sequence: Synthetic oligonucleotide
uaucugcaguccuuacau

SEQ ID NO: 354 - RNA, 18 nt, Artificial Sequence
  Description of Artificial Sequence: Synthetic oligonucleotide
gacuauaucugcaguccu

SEQ ID NO: 355 - RNA, 18 nt, Artificial Sequence
  Description of Artificial Sequence: Synthetic oligonucleotide
cuacugacuauaucugca

SEQ ID NO: 356 - RNA, 18 nt, Artificial Sequence
  Description of Artificial Sequence: Synthetic oligonucleotide
ggucacuacugacuauau

SEQ ID NO: 357 - RNA, 18 nt, Artificial Sequence
  Description of Artificial Sequence: Synthetic oligonucleotide
ggucuggucacuacugac

SEQ ID NO: 358 - RNA, 18 nt, Artificial Sequence
  Description of Artificial Sequence: Synthetic oligonucleotide
uguuuggucuggucacua

SEQ ID NO: 359 - RNA, 18 nt, Artificial Sequence
  Description of Artificial Sequence: Synthetic oligonucleotide
gucuuuguuuggucuggu

SEQ ID NO: 360 - RNA, 18 nt, Artificial Sequence
  Description of Artificial Sequence: Synthetic oligonucleotide
aagaggucuuuguuuggu

SEQ ID NO: 361 - RNA, 18 nt, Artificial Sequence
  Description of Artificial Sequence: Synthetic oligonucleotide
agacaaagaggucuuugu

SEQ ID NO: 362 - RNA, 18 nt, Artificial Sequence
  Description of Artificial Sequence: Synthetic oligonucleotide
aaaaaagacaaagagguc

SEQ ID NO: 363 - RNA, 18 nt, Artificial Sequence
  Description of Artificial Sequence: Synthetic oligonucleotide
acaagaaaaaagacaaag

SEQ ID NO: 364 - RNA, 18 nt, Artificial Sequence
  Description of Artificial Sequence: Synthetic oligonucleotide
aaaauacaagaaaaaaga

SEQ ID NO: 365 - RNA, 18 nt, Artificial Sequence
  Description of Artificial Sequence: Synthetic oligonucleotide
caaagaaaauacaagaaa

SEQ ID NO: 366 - RNA, 18 nt, Artificial Sequence
  Description of Artificial Sequence: Synthetic oligonucleotide
agaaacaaagaaaauaca

SEQ ID NO: 367 - RNA, 18 nt, Artificial Sequence
  Description of Artificial Sequence: Synthetic oligonucleotide
aauauagaaacaaagaaa

SEQ ID NO: 368 - RNA, 18 nt, Artificial Sequence
  Description of Artificial Sequence: Synthetic oligonucleotide
agagcaauauagaaacaa

SEQ ID NO: 369 - RNA, 18 nt, Artificial Sequence
  Description of Artificial Sequence: Synthetic oligonucleotide
uagaaagagcaauauaga

SEQ ID NO: 370 - RNA, 18 nt, Artificial Sequence
  Description of Artificial Sequence: Synthetic oligonucleotide
uuauauagaaagagcaau

SEQ ID NO: 371 - RNA, 18 nt, Artificial Sequence
  Description of Artificial Sequence: Synthetic oligonucleotide
cuuguuuauauagaaaga

SEQ ID NO: 372 - RNA, 18 nt, Artificial Sequence
  Description of Artificial Sequence: Synthetic oligonucleotide
auuuacuuguuuauauag

SEQ ID NO: 373 - RNA, 18 nt, Artificial Sequence
  Description of Artificial Sequence: Synthetic oligonucleotide
uauuaauuuacuuguuua

SEQ ID NO: 374 - RNA, 18 nt, Artificial Sequence
  Description of Artificial Sequence: Synthetic oligonucleotide
ugauuuauuaauuuacuu

SEQ ID NO: 375 - RNA, 18 nt, Artificial Sequence
  Description of Artificial Sequence: Synthetic oligonucleotide
guuacugauuuauuaauu

SEQ ID NO: 376 - RNA, 18 nt, Artificial Sequence
  Description of Artificial Sequence: Synthetic oligonucleotide
gcaaaguuacugauuuau

SEQ ID NO: 377 - RNA, 18 nt, Artificial Sequence
  Description of Artificial Sequence: Synthetic oligonucleotide
aaauggcaaaguuacuga

SEQ ID NO: 378 - RNA, 18 nt, Artificial Sequence
  Description of Artificial Sequence: Synthetic oligonucleotide
auaaaaaauggcaaaguu

SEQ ID NO: 379 - RNA, 18 nt, Artificial Sequence
  Description of Artificial Sequence: Synthetic oligonucleotide
ucacaauaaaaaauggca

SEQ ID NO: 380 - RNA, 18 nt, Artificial Sequence
  Description of Artificial Sequence: Synthetic oligonucleotide
ucuaaucacaauaaaaaa

SEQ ID NO: 381 - RNA, 18 nt, Artificial Sequence
  Description of Artificial Sequence: Synthetic oligonucleotide
agccuucuaaucacaaua

SEQ ID NO: 382 - RNA, 18 nt, Artificial Sequence
  Description of Artificial Sequence: Synthetic oligonucleotide
aaacaagccuucuaauca

SEQ ID NO: 383 - RNA, 18 nt, Artificial Sequence
  Description of Artificial Sequence: Synthetic oligonucleotide
cagggaaacaagccuucu

SEQ ID NO: 384 - RNA, 18 nt, Artificial Sequence
  Description of Artificial Sequence: Synthetic oligonucleotide
cugaucagggaaacaagc

SEQ ID NO: 385 - RNA, 18 nt, Artificial Sequence
  Description of Artificial Sequence: Synthetic oligonucleotide
gguagcugaucagggaaa

SEQ ID NO: 386 - RNA, 18 nt, Artificial Sequence
  Description of Artificial Sequence: Synthetic oligonucleotide
guuuugguagcugaucag

SEQ ID NO: 387 - RNA, 18 nt, Artificial Sequence
  Description of Artificial Sequence: Synthetic oligonucleotide
auuccguuuugguagcug

SEQ ID NO: 388 - RNA, 18 nt, Artificial Sequence
  Description of Artificial Sequence: Synthetic oligonucleotide
aguguauuccguuuuggu

SEQ ID NO: 389 - RNA, 18 nt, Artificial Sequence
  Description of Artificial Sequence: Synthetic oligonucleotide
uguuaaguguauuccguu

SEQ ID NO: 390 - RNA, 18 nt, Artificial Sequence
  Description of Artificial Sequence: Synthetic oligonucleotide
cuaucuguuaaguguauu

SEQ ID NO: 391 - RNA, 18 nt, Artificial Sequence
  Description of Artificial Sequence: Synthetic oligonucleotide
augaucuaucuguuaagu

SEQ ID NO: 392 - RNA, 18 nt, Artificial Sequence
  Description of Artificial Sequence: Synthetic oligonucleotide
ggaagaugaucuaucugu

SEQ ID NO: 393 - RNA, 18 nt, Artificial Sequence
  Description of Artificial Sequence: Synthetic oligonucleotide
guuuuggaagaugaucua

SEQ ID NO: 394 - RNA, 18 nt, Artificial Sequence
  Description of Artificial Sequence: Synthetic oligonucleotide
uauguguuuuggaagaug

SEQ ID NO: 395 - RNA, 18 nt, Artificial Sequence
  Description of Artificial Sequence: Synthetic oligonucleotide
aaguguauguguuuugga

SEQ ID NO: 396 - RNA, 18 nt, Artificial Sequence
  Description of Artificial Sequence: Synthetic oligonucleotide
guauuaaguguauguguu

SEQ ID NO: 397 - RNA, 18 nt, Artificial Sequence
  Description of Artificial Sequence: Synthetic oligonucleotide
uagguguauuaaguguau

SEQ ID NO: 398 - RNA, 18 nt, Artificial Sequence
  Description of Artificial Sequence: Synthetic oligonucleotide
ccaauuagguguauuaag

SEQ ID NO: 399 - RNA, 18 nt, Artificial Sequence
  Description of Artificial Sequence: Synthetic oligonucleotide
acaauccaauuaggugua

SEQ ID NO: 400 - RNA, 18 nt, Artificial Sequence
  Description of Artificial Sequence: Synthetic oligonucleotide
uaauuacaauccaauuag

SEQ ID NO: 401 - RNA, 18 nt, Artificial Sequence
  Description of Artificial Sequence: Synthetic oligonucleotide
ccaauuaauuacaaucca

SEQ ID NO: 402 - RNA, 18 nt, Artificial Sequence
  Description of Artificial Sequence: Synthetic oligonucleotide
cccuaccaauuaauuaca

SEQ ID NO: 403 - RNA, 18 nt, Artificial Sequence
  Description of Artificial Sequence: Synthetic oligonucleotide
uuaaucccuaccaauuaa

SEQ ID NO: 404 - RNA, 18 nt, Artificial Sequence
  Description of Artificial Sequence: Synthetic oligonucleotide
agcaguuaaucccuacca

SEQ ID NO: 405 - RNA, 18 nt, Artificial Sequence
  Description of Artificial Sequence: Synthetic oligonucleotide
ucagcagcaguuaauccc

SEQ ID NO: 406 - RNA, 18 nt, Artificial Sequence
  Description of Artificial Sequence: Synthetic oligonucleotide
agaacucagcagcaguua

SEQ ID NO: 407 - RNA, 18 nt, Artificial Sequence
  Description of Artificial Sequence: Synthetic oligonucleotide
auaauagaacucagcagc

SEQ ID NO: 408 - RNA, 18 nt, Artificial Sequence
  Description of Artificial Sequence: Synthetic oligonucleotide
uccaaauaauagaacuca

SEQ ID NO: 409 - RNA, 18 nt, Artificial Sequence
  Description of Artificial Sequence: Synthetic oligonucleotide
uuugauccaaauaauaga

SEQ ID NO: 410 - RNA, 18 nt, Artificial Sequence
  Description of Artificial Sequence: Synthetic oligonucleotide
caaacuuugauccaaaua

SEQ ID NO: 411 - RNA, 18 nt, Artificial Sequence
  Description of Artificial Sequence: Synthetic oligonucleotide
uuccccaaacuuugaucc

SEQ ID NO: 412 - RNA, 18 nt, Artificial Sequence
  Description of Artificial Sequence: Synthetic oligonucleotide
ugucauuccccaaacuuu

SEQ ID NO: 413 - RNA, 18 nt, Artificial Sequence
  Description of Artificial Sequence: Synthetic oligonucleotide
cuaaaugucauuccccaa

SEQ ID NO: 414 - RNA, 18 nt, Artificial Sequence
  Description of Artificial Sequence: Synthetic oligonucleotide
aaaaccuaaaugucauuc

SEQ ID NO: 415 - RNA, 18 nt, Artificial Sequence
  Description of Artificial Sequence: Synthetic oligonucleotide
auucuaaaaccuaaaugu

SEQ ID NO: 416 - RNA, 18 nt, Artificial Sequence
  Description of Artificial Sequence: Synthetic oligonucleotide
uucuaauucuaaaaccua

SEQ ID NO: 417 - RNA, 18 nt, Artificial Sequence
  Description of Artificial Sequence: Synthetic oligonucleotide
ccugguucuaauucuaaa

SEQ ID NO: 418 - RNA, 18 nt, Artificial Sequence
  Description of Artificial Sequence: Synthetic oligonucleotide
cuaugccugguucuaauu

SEQ ID NO: 419 - RNA, 18 nt, Artificial Sequence
  Description of Artificial Sequence: Synthetic oligonucleotide
uauccuuuuaagaauuuu

SEQ ID NO: 420 - RNA, 18 nt, Artificial Sequence
  Description of Artificial Sequence: Synthetic oligonucleotide
gcaacuauccuuuuaaga

SEQ ID NO: 421 - RNA, 18 nt, Artificial Sequence
  Description of Artificial Sequence: Synthetic oligonucleotide
ggguugcaacuauccuuu

SEQ ID NO: 422 - RNA, 18 nt, Artificial Sequence
  Description of Artificial Sequence: Synthetic oligonucleotide
aggcaggguugcaacuau

SEQ ID NO: 423 - RNA, 18 nt, Artificial Sequence
  Description of Artificial Sequence: Synthetic oligonucleotide
cauaaaggcaggguugca

SEQ ID NO: 424 - RNA, 18 nt, Artificial Sequence
  Description of Artificial Sequence: Synthetic oligonucleotide
ggauacauaaaggcaggg

SEQ ID NO: 425 - RNA, 18 nt, Artificial Sequence
  Description of Artificial Sequence: Synthetic oligonucleotide
uaccaggauacauaaagg

SEQ ID NO: 426 - RNA, 18 nt, Artificial Sequence
  Description of Artificial Sequence: Synthetic oligonucleotide
gauaguaccaggauacau

SEQ ID NO: 427 - RNA, 18 nt, Artificial Sequence
  Description of Artificial Sequence: Synthetic oligonucleotide
guaaggauaguaccagga

SEQ ID NO: 428 - RNA, 18 nt, Artificial Sequence
  Description of Artificial Sequence: Synthetic oligonucleotide
acaauguaaggauaguac

SEQ ID NO: 429 - RNA, 18 nt, Artificial Sequence
  Description of Artificial Sequence: Synthetic oligonucleotide
uuguaacaauguaaggau

SEQ ID NO: 430 - RNA, 18 nt, Artificial Sequence
  Description of Artificial Sequence: Synthetic oligonucleotide
cuuuauuguaacaaugua

SEQ ID NO: 431 - RNA, 18 nt, Artificial Sequence
  Description of Artificial Sequence: Synthetic oligonucleotide
uuucucuuuauuguaaca

SEQ ID NO: 432 - RNA, 18 nt, Artificial Sequence
  Description of Artificial Sequence: Synthetic oligonucleotide
uaagauuucucuuuauug

SEQ ID NO: 433 - RNA, 18 nt, Artificial Sequence
  Description of Artificial Sequence: Synthetic oligonucleotide
aaauuuaagauuucucuu

SEQ ID NO: 434 - RNA, 18 nt, Artificial Sequence
  Description of Artificial Sequence: Synthetic oligonucleotide
auugaaaauuuaagauuu

SEQ ID NO: 435 - RNA, 18 nt, Artificial Sequence
  Description of Artificial Sequence: Synthetic oligonucleotide
aagugauugaaaauuuaa

SEQ ID NO: 436 - RNA, 18 nt, Artificial Sequence
  Description of Artificial Sequence: Synthetic oligonucleotide
gaucaaagugauugaaaa

SEQ ID NO: 437 - RNA, 18 nt, Artificial Sequence
  Description of Artificial Sequence: Synthetic oligonucleotide
agggugaucaaagugauu

SEQ ID NO: 438 - RNA, 18 nt, Artificial Sequence
  Description of Artificial Sequence: Synthetic oligonucleotide
ucugcagggugaucaaag

SEQ ID NO: 439 - RNA, 18 nt, Artificial Sequence
  Description of Artificial Sequence: Synthetic oligonucleotide
auuuaucugcagggugau

SEQ ID NO: 440 - RNA, 18 nt, Artificial Sequence
  Description of Artificial Sequence: Synthetic oligonucleotide
cuaaaauuuaucugcagg

SEQ ID NO: 441 - RNA, 18 nt, Artificial Sequence
  Description of Artificial Sequence: Synthetic oligonucleotide
aucugcuaaaauuuaucu

SEQ ID NO: 442 - RNA, 18 nt, Artificial Sequence
  Description of Artificial Sequence: Synthetic oligonucleotide
ggaucaucugcuaaaauu

SEQ ID NO: 443 - RNA, 18 nt, Artificial Sequence
  Description of Artificial Sequence: Synthetic oligonucleotide
ucuaaggaucaucugcua

SEQ ID NO: 444 - RNA, 18 nt, Artificial Sequence
  Description of Artificial Sequence: Synthetic oligonucleotide
uuagaucuaaggaucauc

SEQ ID NO: 445 - RNA, 18 nt, Artificial Sequence
  Description of Artificial Sequence: Synthetic oligonucleotide
acaacuuagaucuaagga

SEQ ID NO: 446 - RNA, 18 nt, Artificial Sequence
  Description of Artificial Sequence: Synthetic oligonucleotide
uaauuacaacuuagaucu

SEQ ID NO: 447 - RNA, 18 nt, Artificial Sequence
  Description of Artificial Sequence: Synthetic oligonucleotide
ccaaauaauuacaacuua

SEQ ID NO: 448 - RNA, 18 nt, Artificial Sequence
  Description of Artificial Sequence: Synthetic oligonucleotide
aucagccaaauaauuaca

SEQ ID NO: 449 - RNA, 18 nt, Artificial Sequence
  Description of Artificial Sequence: Synthetic oligonucleotide
gcucuaucagccaaauaa

SEQ ID NO: 450 - RNA, 18 nt, Artificial Sequence
  Description of Artificial Sequence: Synthetic oligonucleotide
caauagcucuaucagcca

SEQ ID NO: 451 - RNA, 18 nt, Artificial Sequence
  Description of Artificial Sequence: Synthetic oligonucleotide
ugggucaauagcucuauc

SEQ ID NO: 452 - RNA, 18 nt, Artificial Sequence
  Description of Artificial Sequence: Synthetic oligonucleotide
acacaugggucaauagcu

SEQ ID NO: 453 - RNA, 18 nt, Artificial Sequence
  Description of Artificial Sequence: Synthetic oligonucleotide
ugccaacacaugggucaa

SEQ ID NO: 454 - RNA, 18 nt, Artificial Sequence
  Description of Artificial Sequence: Synthetic oligonucleotide
acaaaugccaacacaugg

SEQ ID NO: 455 - RNA, 18 nt, Artificial Sequence
  Description of Artificial Sequence: Synthetic oligonucleotide
gucuuacaaaugccaaca

SEQ ID NO: 456 - RNA, 18 nt, Artificial Sequence
  Description of Artificial Sequence: Synthetic oligonucleotide
agaaagucuuacaaaugc

SEQ ID NO: 457 - RNA, 18 nt, Artificial Sequence
  Description of Artificial Sequence: Synthetic oligonucleotide
uuuuuagaaagucuuaca

SEQ ID NO: 458 - RNA, 18 nt, Artificial Sequence
  Description of Artificial Sequence: Synthetic oligonucleotide
agcacuuuuuagaaaguc

SEQ ID NO: 459 - RNA, 18 nt, Artificial Sequence
  Description of Artificial Sequence: Synthetic oligonucleotide
gcuggagcacuuuuuaga

SEQ ID NO: 460 - RNA, 18 nt, Artificial Sequence
  Description of Artificial Sequence: Synthetic oligonucleotide
aauuugcuggagcacuuu

SEQ ID NO: 461 - RNA, 18 nt, Artificial Sequence
  Description of Artificial Sequence: Synthetic oligonucleotide
auuaaaauuugcuggagc

SEQ ID NO: 462 - RNA, 18 nt, Artificial Sequence
  Description of Artificial Sequence: Synthetic oligonucleotide
gcaguauuaaaauuugcu

SEQ ID NO: 463 - RNA, 18 nt, Artificial Sequence
  Description of Artificial Sequence: Synthetic oligonucleotide
uuaaagcaguauuaaaau

SEQ ID NO: 464 - RNA, 18 nt, Artificial Sequence
  Description of Artificial Sequence: Synthetic oligonucleotide
gauauuuaaagcaguauu

SEQ ID NO: 465 - RNA, 18 nt, Artificial Sequence
  Description of Artificial Sequence: Synthetic oligonucleotide
gucaugauauuuaaagca

SEQ ID NO: 466 - RNA, 18 nt, Artificial Sequence
  Description of Artificial Sequence: Synthetic oligonucleotide
auggugucaugauauuua

SEQ ID NO: 467 - RNA, 18 nt, Artificial Sequence
  Description of Artificial Sequence: Synthetic oligonucleotide
aguucauggugucaugau

SEQ ID NO: 468 - RNA, 18 nt, Artificial Sequence
  Description of Artificial Sequence: Synthetic oligonucleotide
uuuagaguucaugguguc

SEQ ID NO: 469 - RNA, 18 nt, Artificial Sequence
  Description of Artificial Sequence: Synthetic oligonucleotide
aauucuuuagaguucaug

SEQ ID NO: 470 - RNA, 18 nt, Artificial Sequence
  Description of Artificial Sequence: Synthetic oligonucleotide
uuuucaauucuuuagagu

SEQ ID NO: 471 - RNA, 18 nt, Artificial Sequence
  Description of Artificial Sequence: Synthetic oligonucleotide
agcacuuuucaauucuuu

SEQ ID NO: 472 - RNA, 18 nt, Artificial Sequence
  Description of Artificial Sequence: Synthetic oligonucleotide
ucacaagcacuuuucaau

SEQ ID NO: 473 - RNA, 18 nt, Artificial Sequence
  Description of Artificial Sequence: Synthetic oligonucleotide
ccaacucacaagcacuuu

SEQ ID NO: 474 - RNA, 18 nt, Artificial Sequence
  Description of Artificial Sequence: Synthetic oligonucleotide
gauaaccaacucacaagc

SEQ ID NO: 475 - RNA, 18 nt, Artificial Sequence
  Description of Artificial Sequence: Synthetic oligonucleotide
cccuugauaaccaacuca

SEQ ID NO: 476 - RNA, 18 nt, Artificial Sequence
  Description of Artificial Sequence: Synthetic oligonucleotide
uccuccccuugauaacca

SEQ ID NO: 477 - RNA, 18 nt, Artificial Sequence
  Description of Artificial Sequence: Synthetic oligonucleotide
auauauccuccccuugau

SEQ ID NO: 478 - RNA, 18 nt, Artificial Sequence
  Description of Artificial Sequence: Synthetic oligonucleotide
auuugauauauccucccc

SEQ ID NO: 479 - RNA, 18 nt, Artificial Sequence
  Description of Artificial Sequence: Synthetic oligonucleotide
uggccauuugauauaucc

SEQ ID NO: 480 - RNA, 18 nt, Artificial Sequence
  Description of Artificial Sequence: Synthetic oligonucleotide
caaaauggccauuugaua

SEQ ID NO: 481 - RNA, 18 nt, Artificial Sequence
  Description of Artificial Sequence: Synthetic oligonucleotide
uugaacaaaauggccauu

SEQ ID NO: 482 - RNA, 18 nt, Artificial Sequence
  Description of Artificial Sequence: Synthetic oligonucleotide
acauauugaacaaaaugg

SEQ ID NO: 483 - RNA, 18 nt, Artificial Sequence
  Description of Artificial Sequence: Synthetic oligonucleotide
agaacacauauugaacaa

SEQ ID NO: 484 - RNA, 18 nt, Artificial Sequence
  Description of Artificial Sequence: Synthetic oligonucleotide
uuucuagaacacauauug

SEQ ID NO: 485 - RNA, 18 nt, Artificial Sequence
  Description of Artificial Sequence: Synthetic oligonucleotide
uuucauuucuagaacaca

SEQ ID NO: 486 - RNA, 18 nt, Artificial Sequence
  Description of Artificial Sequence: Synthetic oligonucleotide
uggcuuuucauuucuaga

SEQ ID NO: 487 - RNA, 18 nt, Artificial Sequence
  Description of Artificial Sequence: Synthetic oligonucleotide
uaguauggcuuuucauuu

SEQ ID NO: 488 - RNA, 18 nt, Artificial Sequence
  Description of Artificial Sequence: Synthetic oligonucleotide
uauuuuaguauggcuuuu

SEQ ID NO: 489 - RNA, 18 nt, Artificial Sequence
  Description of Artificial Sequence: Synthetic oligonucleotide
gacaguauuuuaguaugg

SEQ ID NO: 490 - RNA, 18 nt, Artificial Sequence
  Description of Artificial Sequence: Synthetic oligonucleotide
accaagacaguauuuuag

SEQ ID NO: 491 - RNA, 18 nt, Artificial Sequence
  Description of Artificial Sequence: Synthetic oligonucleotide
uuuggaccaagacaguau

SEQ ID NO: 492 - RNA, 18 nt, Artificial Sequence
  Description of Artificial Sequence: Synthetic oligonucleotide
cagauuuuggaccaagac

SEQ ID NO: 493 - RNA, 18 nt, Artificial Sequence
  Description of Artificial Sequence: Synthetic oligonucleotide
uuacacagauuuuggacc

SEQ ID NO: 494 - RNA, 18 nt, Artificial Sequence
  Description of Artificial Sequence: Synthetic oligonucleotide
aaauuuuacacagauuuu

SEQ ID NO: 495 - RNA, 18 nt, Artificial Sequence
  Description of Artificial Sequence: Synthetic oligonucleotide
aaaacaaauuuuacacag

SEQ ID NO: 496 - RNA, 18 nt, Artificial Sequence
  Description of Artificial Sequence: Synthetic oligonucleotide
auuucaaaacaaauuuua

SEQ ID NO: 497 - RNA, 18 nt, Artificial Sequence
  Description of Artificial Sequence: Synthetic oligonucleotide
aagacauuucaaaacaaa

SEQ ID NO: 498 - RNA, 18 nt, Artificial Sequence
  Description of Artificial Sequence: Synthetic oligonucleotide
uuugaaagacauuucaaa

SEQ ID NO: 499 - RNA, 18 nt, Artificial Sequence
  Description of Artificial Sequence: Synthetic oligonucleotide
auauuuuugaaagacauu

SEQ ID NO: 500 - RNA, 18 nt, Artificial Sequence
  Description of Artificial Sequence: Synthetic oligonucleotide
agggaauauuuuugaaag

SEQ ID NO: 501 - RNA, 18 nt, Artificial Sequence
  Description of Artificial Sequence: Synthetic oligonucleotide
ucaaaagggaauauuuuu

SEQ ID NO: 502 - RNA, 18 nt, Artificial Sequence
  Description of Artificial Sequence: Synthetic oligonucleotide
aauuuucaaaagggaaua

SEQ ID NO: 503 - RNA, 18 nt, Artificial Sequence
  Description of Artificial Sequence: Synthetic oligonucleotide
gauauaauuuucaaaagg

SEQ ID NO: 504 - RNA, 18 nt, Artificial Sequence
  Description of Artificial Sequence: Synthetic oligonucleotide
uuacugauauaauuuuca

SEQ ID NO: 505 - RNA, 18 nt, Artificial Sequence
  Description of Artificial Sequence: Synthetic oligonucleotide
uauucuuacugauauaau

SEQ ID NO: 506 - RNA, 18 nt, Artificial Sequence
  Description of Artificial Sequence: Synthetic oligonucleotide
auaaauauucuuacugau

SEQ ID NO: 507 - RNA, 18 nt, Artificial Sequence
  Description of Artificial Sequence: Synthetic oligonucleotide
guuuaauaaauauucuua

SEQ ID NO: 508 - RNA, 18 nt, Artificial Sequence
  Description of Artificial Sequence: Synthetic oligonucleotide
cugauguuuaauaaauau

SEQ ID NO: 509 - RNA, 18 nt, Artificial Sequence
  Description of Artificial Sequence: Synthetic oligonucleotide
uagaccugauguuuaaua

SEQ ID NO: 510 - RNA, 18 nt, Artificial Sequence
  Description of Artificial Sequence: Synthetic oligonucleotide
uaauuuagaccugauguu

SEQ ID NO: 511 - RNA, 18 nt, Artificial Sequence
  Description of Artificial Sequence: Synthetic oligonucleotide
aaaaauaauuuagaccug

SEQ ID NO: 512 - RNA, 18 nt, Artificial Sequence
  Description of Artificial Sequence: Synthetic oligonucleotide
ggaguaaaaauaauuuag

SEQ ID NO: 513 - RNA, 18 nt, Artificial Sequence
  Description of Artificial Sequence: Synthetic oligonucleotide
acuuuggaguaaaaauaa

SEQ ID NO: 514 - RNA, 18 nt, Artificial Sequence
  Description of Artificial Sequence: Synthetic oligonucleotide
guuuuacuuuggaguaaa

SEQ ID NO: 515 - RNA, 18 nt, Artificial Sequence
  Description of Artificial Sequence: Synthetic oligonucleotide
ugcauguuuuacuuugga

SEQ ID NO: 516 - RNA, 18 nt, Artificial Sequence
  Description of Artificial Sequence: Synthetic oligonucleotide
uccauccuuugaaugugg

SEQ ID NO: 517 - RNA, 18 nt, Artificial Sequence
  Description of Artificial Sequence: Synthetic oligonucleotide
auccauccauccuuugaa

SEQ ID NO: 518 - RNA, 18 nt, Artificial Sequence
  Description of Artificial Sequence: Synthetic oligonucleotide
auuauauccauccauccu

SEQ ID NO: 519 - RNA, 18 nt, Artificial Sequence
  Description of Artificial Sequence: Synthetic oligonucleotide
cauacauuauauccaucc

SEQ ID NO: 520 - RNA, 18 nt, Artificial Sequence
  Description of Artificial Sequence: Synthetic oligonucleotide
ugcugcauacauuauauc

SEQ ID NO: 521 - RNA, 18 nt, Artificial Sequence
  Description of Artificial Sequence: Synthetic oligonucleotide
ucaacugcugcauacauu

SEQ ID NO: 522 - RNA, 18 nt, Artificial Sequence
  Description of Artificial Sequence: Synthetic oligonucleotide
uggaaucaacugcugcau

SEQ ID NO: 523 - RNA, 18 nt, Artificial Sequence
  Description of Artificial Sequence: Synthetic oligonucleotide
auuucuggaaucaacugc

SEQ ID NO: 524 - RNA, 18 nt, Artificial Sequence
  Description of Artificial Sequence: Synthetic oligonucleotide
aaagggcauucacaacca

SEQ ID NO: 525 - RNA, 18 nt, Artificial Sequence
  Description of Artificial Sequence: Synthetic oligonucleotide
uccuaaaagggcauucac

SEQ ID NO: 526 - RNA, 18 nt, Artificial Sequence
  Description of Artificial Sequence: Synthetic oligonucleotide
auugcuccuaaaagggca

SEQ ID NO: 527 - RNA, 18 nt, Artificial Sequence
  Description of Artificial Sequence: Synthetic oligonucleotide
auggaauugcuccuaaaa

SEQ ID NO: 528 - RNA, 18 nt, Artificial Sequence
  Description of Artificial Sequence: Synthetic oligonucleotide
gauggauggaauugcucc

SEQ ID NO: 529 - RNA, 18 nt, Artificial Sequence
  Description of Artificial Sequence: Synthetic oligonucleotide
uucaugauggauggaauu

SEQ ID NO: 530 - RNA, 18 nt, Artificial Sequence
  Description of Artificial Sequence: Synthetic oligonucleotide
gcacauucaugauggaug

SEQ ID NO: 531 - RNA, 18 nt, Artificial Sequence
  Description of Artificial Sequence: Synthetic oligonucleotide
cagaagcacauucaugau

SEQ ID NO: 532 - RNA, 18 nt, Artificial Sequence
  Description of Artificial Sequence: Synthetic oligonucleotide
caaaccagaagcacauuc

SEQ ID NO: 533 - RNA, 18 nt, Artificial Sequence
  Description of Artificial Sequence: Synthetic oligonucleotide
uaagacaaaccagaagca

SEQ ID NO: 534 - RNA, 18 nt, Artificial Sequence
  Description of Artificial Sequence: Synthetic oligonucleotide
gaauauaagacaaaccag

SEQ ID NO: 535 - RNA, 18 nt, Artificial Sequence
  Description of Artificial Sequence: Synthetic oligonucleotide
agccagaauauaagacaa

SEQ ID NO: 536 - RNA, 18 nt, Artificial Sequence
  Description of Artificial Sequence: Synthetic oligonucleotide
aaauuagccagaauauaa

SEQ ID NO: 537 - RNA, 18 nt, Artificial Sequence
  Description of Artificial Sequence: Synthetic oligonucleotide
gcugaaaauuagccagaa

SEQ ID NO: 538 - RNA, 18 nt, Artificial Sequence
  Description of Artificial Sequence: Synthetic oligonucleotide
augaugcugaaaauuagc

SEQ ID NO: 539 - RNA, 18 nt, Artificial Sequence
  Description of Artificial Sequence: Synthetic oligonucleotide
cgcccaugaugcugaaaa

SEQ ID NO: 540 - RNA, 18 nt, Artificial Sequence
  Description of Artificial Sequence: Synthetic oligonucleotide
auuuacgcccaugaugcu

SEQ ID NO: 541 - RNA, 18 nt, Artificial Sequence
  Description of Artificial Sequence: Synthetic oligonucleotide
aacaaauuuacgcccaug

SEQ ID NO: 542 - RNA, 18 nt, Artificial Sequence
  Description of Artificial Sequence: Synthetic oligonucleotide
cagcaaacaaauuuacgc

SEQ ID NO: 543 - RNA, 18 nt, Artificial Sequence
  Description of Artificial Sequence: Synthetic oligonucleotide
uuugccagcaaacaaauu

SEQ ID NO: 544 - RNA, 18 nt, Artificial Sequence
  Description of Artificial Sequence: Synthetic oligonucleotide
uagaauuugccagcaaac

SEQ ID NO: 545 - RNA, 18 nt, Artificial Sequence
  Description of Artificial Sequence: Synthetic oligonucleotide
agugguagaauuugccag

SEQ ID NO: 546 - RNA, 18 nt, Artificial Sequence
  Description of Artificial Sequence: Synthetic oligonucleotide
aauacagugguagaauuu

SEQ ID NO: 547 - RNA, 18 nt, Artificial Sequence
  Description of Artificial Sequence: Synthetic oligonucleotide
guguuaauacagugguag

SEQ ID NO: 548 - RNA, 18 nt, Artificial Sequence
  Description of Artificial Sequence: Synthetic oligonucleotide
uugugguguuaauacagu

SEQ ID NO: 549 - RNA, 18 nt, Artificial Sequence
  Description of Artificial Sequence: Synthetic oligonucleotide
accaguugugguguuaau

SEQ ID NO: 550 - RNA, 18 nt, Artificial Sequence
  Description of Artificial Sequence: Synthetic oligonucleotide
cugucaccaguuguggug

SEQ ID NO: 551 - RNA, 18 nt, Artificial Sequence
  Description of Artificial Sequence: Synthetic oligonucleotide
caaaccugucaccaguug

SEQ ID NO: 552 - RNA, 18 nt, Artificial Sequence
  Description of Artificial Sequence: Synthetic oligonucleotide
gaugucaaaccugucacc

SEQ ID NO: 553 - RNA, 18 nt, Artificial Sequence
  Description of Artificial Sequence: Synthetic oligonucleotide
ucuucgaugucaaaccug

SEQ ID NO: 554 - RNA, 18 nt, Artificial Sequence
  Description of Artificial Sequence: Synthetic oligonucleotide
ucacgucuucgaugucaa

SEQ ID NO: 555 - RNA, 18 nt, Artificial Sequence
  Description of Artificial Sequence: Synthetic oligonucleotide
auuauucacgucuucgau

SEQ ID NO: 556 - RNA, 18 nt, Artificial Sequence
  Description of Artificial Sequence: Synthetic oligonucleotide
guaugauuauucacgucu

SEQ ID NO: 557 - RNA, 18 nt, Artificial Sequence
  Description of Artificial Sequence: Synthetic oligonucleotide
aaucaguaugauuauuca

SEQ ID NO: 558 - RNA, 18 nt, Artificial Sequence
  Description of Artificial Sequence: Synthetic oligonucleotide
uaggcaaucaguaugauu

SEQ ID NO: 559 - RNA, 18 nt, Artificial Sequence
  Description of Artificial Sequence: Synthetic oligonucleotide
aguuuuaggcaaucagua

SEQ ID NO: 560 - RNA, 18 nt, Artificial Sequence
  Description of Artificial Sequence: Synthetic oligonucleotide
cuauuaguuuuaggcaau

SEQ ID NO: 561 - RNA, 18 nt, Artificial Sequence
  Description of Artificial Sequence: Synthetic oligonucleotide
ucuuucuauuaguuuuag

SEQ ID NO: 562 - RNA, 18 nt, Artificial Sequence
  Description of Artificial Sequence: Synthetic oligonucleotide
ucauuucuuucuauuagu

SEQ ID NO: 563 - RNA, 18 nt, Artificial Sequence
  Description of Artificial Sequence: Synthetic oligonucleotide
cagucucauuucuuucua

SEQ ID NO: 564 - RNA, 18 nt, Artificial Sequence
  Description of Artificial Sequence: Synthetic oligonucleotide
ucgagcagucucauuucu

SEQ ID NO: 565 - RNA, 18 nt, Artificial Sequence
  Description of Artificial Sequence: Synthetic oligonucleotide
uuccaucgagcagucuca

SEQ ID NO: 566 - RNA, 18 nt, Artificial Sequence
  Description of Artificial Sequence: Synthetic oligonucleotide
cauuuuuccaucgagcag

SEQ ID NO: 567 - RNA, 18 nt, Artificial Sequence
  Description of Artificial Sequence: Synthetic oligonucleotide
uuucacauuuuuccaucg

SEQ ID NO: 568 - RNA, 18 nt, Artificial Sequence
  Description of Artificial Sequence: Synthetic oligonucleotide
uuuacuuucacauuuuuc

SEQ ID NO: 569 - RNA, 18 nt, Artificial Sequence
  Description of Artificial Sequence: Synthetic oligonucleotide
caaaguuuacuuucacau

SEQ ID NO: 570 - RNA, 18 nt, Artificial Sequence
  Description of Artificial Sequence: Synthetic oligonucleotide
auuaucaaaguuuacuuu

SEQ ID NO: 571 - RNA, 18 nt, Artificial Sequence
  Description of Artificial Sequence: Synthetic oligonucleotide
ccuacauuaucaaaguuu

SEQ ID NO: 572 - RNA, 18 nt, Artificial Sequence
  Description of Artificial Sequence: Synthetic oligonucleotide
caaauccuacauuaucaa

SEQ ID NO: 573 - RNA, 18 nt, Artificial Sequence
  Description of Artificial Sequence: Synthetic oligonucleotide
auacccaaauccuacauu

SEQ ID NO: 574 - RNA, 18 nt, Artificial Sequence
  Description of Artificial Sequence: Synthetic oligonucleotide
gagagauacccaaauccu

SEQ ID NO: 575 - RNA, 18 nt, Artificial Sequence
  Description of Artificial Sequence: Synthetic oligonucleotide
gcaaagagagauacccaa

SEQ ID NO: 576 - RNA, 18 nt, Artificial Sequence
  Description of Artificial Sequence: Synthetic oligonucleotide
uugaagcaaagagagaua

SEQ ID NO: 577 - RNA, 18 nt, Artificial Sequence
  Description of Artificial Sequence: Synthetic oligonucleotide
cagagaaaauaguguuca

SEQ ID NO: 578 - RNA, 18 nt, Artificial Sequence
  Description of Artificial Sequence: Synthetic oligonucleotide
auauucagagaaaauagu

SEQ ID NO: 579 - RNA, 18 nt, Artificial Sequence
  Description of Artificial Sequence: Synthetic oligonucleotide
uaaaaauauucagagaaa

SEQ ID NO: 580 - RNA, 18 nt, Artificial Sequence
  Description of Artificial Sequence: Synthetic oligonucleotide
aacaauaaaaauauucag

SEQ ID NO: 581 - RNA, 18 nt, Artificial Sequence
  Description of Artificial Sequence: Synthetic oligonucleotide
uuccaaacaauaaaaaua

SEQ ID NO: 582 - RNA, 18 nt, Artificial Sequence
  Description of Artificial Sequence: Synthetic oligonucleotide
uauuauuccaaacaauaa

SEQ ID NO: 583 - RNA, 18 nt, Artificial Sequence
  Description of Artificial Sequence: Synthetic oligonucleotide
uuuguuauuauuccaaac

SEQ ID NO: 584 - RNA, 18 nt, Artificial Sequence
  Description of Artificial Sequence: Synthetic oligonucleotide
auuauuuuguuauuauuc

SEQ ID NO: 585 - RNA, 18 nt, Artificial Sequence
  Description of Artificial Sequence: Synthetic oligonucleotide
augucauuauuuuguuau

SEQ ID NO: 586 - RNA, 18 nt, Artificial Sequence
  Description of Artificial Sequence: Synthetic oligonucleotide
gauguaugucauuauuuu

SEQ ID NO: 587 - RNA, 18 nt, Artificial Sequence
  Description of Artificial Sequence: Synthetic oligonucleotide
uaauagauguaugucauu

SEQ ID NO: 588 - RNA, 18 nt, Artificial Sequence
  Description of Artificial Sequence: Synthetic oligonucleotide
cuaaauaauagauguaug

SEQ ID NO: 589 - RNA, 18 nt, Artificial Sequence
  Description of Artificial Sequence: Synthetic oligonucleotide
aggaacuaaauaauagau

SEQ ID NO: 590 - RNA, 18 nt, Artificial Sequence
  Description of Artificial Sequence: Synthetic oligonucleotide
uucuuaggaacuaaauaa

SEQ ID NO: 591 - RNA, 18 nt, Artificial Sequence
  Description of Artificial Sequence: Synthetic oligonucleotide
acuuuuucuuaggaacua

SEQ ID NO: 592 - RNA, 18 nt, Artificial Sequence
  Description of Artificial Sequence: Synthetic oligonucleotide
uauauacuuuuucuuagg

SEQ ID NO: 593 - RNA, 18 nt, Artificial Sequence
  Description of Artificial Sequence: Synthetic oligonucleotide
agaaauauauacuuuuuc

SEQ ID NO: 594 - RNA, 18 nt, Artificial Sequence
  Description of Artificial Sequence: Synthetic oligonucleotide
uagaaagaaauauauacu

SEQ ID NO: 595 - RNA, 18 nt, Artificial Sequence
  Description of Artificial Sequence: Synthetic oligonucleotide
uuaaauagaaagaaauau

SEQ ID NO: 596 - RNA, 18 nt, Artificial Sequence
  Description of Artificial Sequence: Synthetic oligonucleotide
auuuuuuaaauagaaaga

SEQ ID NO: 597 - RNA, 18 nt, Artificial Sequence
  Description of Artificial Sequence: Synthetic oligonucleotide
uugaaauuuuuuaaauag

SEQ ID NO: 598 - RNA, 18 nt, Artificial Sequence
  Description of Artificial Sequence: Synthetic oligonucleotide
acaaauugaaauuuuuua

SEQ ID NO: 599 - RNA, 18 nt, Artificial Sequence
  Description of Artificial Sequence: Synthetic oligonucleotide
uacuaacaaauugaaauu

SEQ ID NO: 600 - RNA, 18 nt, Artificial Sequence
  Description of Artificial Sequence: Synthetic oligonucleotide
acuuguacuaacaaauug

SEQ ID NO: 601 - RNA, 18 nt, Artificial Sequence
  Description of Artificial Sequence: Synthetic oligonucleotide
cauaaacuuguacuaaca

SEQ ID NO: 602 - RNA, 18 nt, Artificial Sequence
  Description of Artificial Sequence: Synthetic oligonucleotide
gggcucauaaacuuguac

SEQ ID NO: 603 - RNA, 18 nt, Artificial Sequence
  Description of Artificial Sequence: Synthetic oligonucleotide
caucugggcucauaaacu

SEQ ID NO: 604 - RNA, 18 nt, Artificial Sequence
  Description of Artificial Sequence: Synthetic oligonucleotide
ucacccaucugggcucau

SEQ ID NO: 605 - RNA, 18 nt, Artificial Sequence
  Description of Artificial Sequence: Synthetic oligonucleotide
aguuuucacccaucuggg

SEQ ID NO: 606 - RNA, 18 nt, Artificial Sequence
  Description of Artificial Sequence: Synthetic oligonucleotide
aauaaaguuuucacccau

SEQ ID NO: 607 - RNA, 18 nt, Artificial Sequence
  Description of Artificial Sequence: Synthetic oligonucleotide
cauguaauaaaguuuuca

SEQ ID NO: 608 - RNA, 18 nt, Artificial Sequence
  Description of Artificial Sequence: Synthetic oligonucleotide
ccuuacauguaauaaagu

SEQ ID NO: 609 - RNA, 18 nt, Artificial Sequence
  Description of Artificial Sequence: Synthetic oligonucleotide
gcaguccuuacauguaau

SEQ ID NO: 610 - RNA, 18 nt, Artificial Sequence
  Description of Artificial Sequence: Synthetic oligonucleotide
uaucugcaguccuuacau

SEQ ID NO: 611 - RNA, 18 nt, Artificial Sequence
  Description of Artificial Sequence: Synthetic oligonucleotide
gacuauaucugcaguccu

SEQ ID NO: 612 - RNA, 18 nt, Artificial Sequence
  Description of Artificial Sequence: Synthetic oligonucleotide
cuacugacuauaucugca

SEQ ID NO: 613 - RNA, 18 nt, Artificial Sequence
  Description of Artificial Sequence: Synthetic oligonucleotide
ggucacuacugacuauau

SEQ ID NO: 614 - RNA, 18 nt, Artificial Sequence
  Description of Artificial Sequence: Synthetic oligonucleotide
ggucuggucacuacugac

SEQ ID NO: 615 - RNA, 18 nt, Artificial Sequence
  Description of Artificial Sequence: Synthetic oligonucleotide
uguuuggucuggucacua

SEQ ID NO: 616 - RNA, 18 nt, Artificial Sequence
  Description of Artificial Sequence: Synthetic oligonucleotide
gucuuuguuuggucuggu

SEQ ID NO: 617 - RNA, 18 nt, Artificial Sequence
  Description of Artificial Sequence: Synthetic oligonucleotide
aagaggucuuuguuuggu

SEQ ID NO: 618 - RNA, 18 nt, Artificial Sequence
  Description of Artificial Sequence: Synthetic oligonucleotide
agacaaagaggucuuugu

SEQ ID NO: 619 - RNA, 18 nt, Artificial Sequence
  Description of Artificial Sequence: Synthetic oligonucleotide
aaaaaagacaaagagguc

SEQ ID NO: 620 - RNA, 18 nt, Artificial Sequence
  Description of Artificial Sequence: Synthetic oligonucleotide
acaagaaaaaagacaaag

SEQ ID NO: 621 - RNA, 18 nt, Artificial Sequence
  Description of Artificial Sequence: Synthetic oligonucleotide
aaaauacaagaaaaaaga

SEQ ID NO: 622 - RNA, 18 nt, Artificial Sequence
  Description of Artificial Sequence: Synthetic oligonucleotide
caaagaaaauacaagaaa

SEQ ID NO: 623 - RNA, 18 nt, Artificial Sequence
  Description of Artificial Sequence: Synthetic oligonucleotide
agaaacaaagaaaauaca

SEQ ID NO: 624 - RNA, 18 nt, Artificial Sequence
  Description of Artificial Sequence: Synthetic oligonucleotide
aauauagaaacaaagaaa

SEQ ID NO: 625 - RNA, 18 nt, Artificial Sequence
  Description of Artificial Sequence: Synthetic oligonucleotide
agagcaauauagaaacaa

SEQ ID NO: 626 - RNA, 18 nt, Artificial Sequence
  Description of Artificial Sequence: Synthetic oligonucleotide
uagaaagagcaauauaga

SEQ ID NO: 627 - RNA, 18 nt, Artificial Sequence
  Description of Artificial Sequence: Synthetic oligonucleotide
uuauauagaaagagcaau

SEQ ID NO: 628 - RNA, 18 nt, Artificial Sequence
  Description of Artificial Sequence: Synthetic oligonucleotide
cuuguuuauauagaaaga

SEQ ID NO: 629 - RNA, 18 nt, Artificial Sequence
  Description of Artificial Sequence: Synthetic oligonucleotide
auuuacuuguuuauauag

SEQ ID NO: 630 - RNA, 18 nt, Artificial Sequence
  Description of Artificial Sequence: Synthetic oligonucleotide
uauuaauuuacuuguuua

SEQ ID NO: 631 - RNA, 18 nt, Artificial Sequence
  Description of Artificial Sequence: Synthetic oligonucleotide
ugauuuauuaauuuacuu

SEQ ID NO: 632 - RNA, 18 nt, Artificial Sequence
  Description of Artificial Sequence: Synthetic oligonucleotide
guuacugauuuauuaauu

SEQ ID NO: 633 - RNA, 18 nt, Artificial Sequence
  Description of Artificial Sequence: Synthetic oligonucleotide
gcaaaguuacugauuuau

SEQ ID NO: 634 - RNA, 18 nt, Artificial Sequence
  Description of Artificial Sequence: Synthetic oligonucleotide
aaauggcaaaguuacuga

SEQ ID NO: 635 - RNA, 18 nt, Artificial Sequence
  Description of Artificial Sequence: Synthetic oligonucleotide
auaaaaaauggcaaaguu

SEQ ID NO: 636 - RNA, 18 nt, Artificial Sequence
  Description of Artificial Sequence: Synthetic oligonucleotide
ucacaauaaaaaauggca

SEQ ID NO: 637 - RNA, 18 nt, Artificial Sequence
  Description of Artificial Sequence: Synthetic oligonucleotide
ucuaaucacaauaaaaaa

SEQ ID NO: 638 - RNA, 18 nt, Artificial Sequence
  Description of Artificial Sequence: Synthetic oligonucleotide
agccuucuaaucacaaua

SEQ ID NO: 639 - RNA, 18 nt, Artificial Sequence
  Description of Artificial Sequence: Synthetic oligonucleotide
aaacaagccuucuaauca

SEQ ID NO: 640 - RNA, 18 nt, Artificial Sequence
  Description of Artificial Sequence: Synthetic oligonucleotide
cagggaaacaagccuucu

SEQ ID NO: 641 - RNA, 18 nt, Artificial Sequence
  Description of Artificial Sequence: Synthetic oligonucleotide
cugaucagggaaacaagc

SEQ ID NO: 642 - RNA, 18 nt, Artificial Sequence
  Description of Artificial Sequence: Synthetic oligonucleotide
gguagcugaucagggaaa

SEQ ID NO: 643 - RNA, 18 nt, Artificial Sequence
  Description of Artificial Sequence: Synthetic oligonucleotide
guuuugguagcugaucag

SEQ ID NO: 644 - RNA, 18 nt, Artificial Sequence
  Description of Artificial Sequence: Synthetic oligonucleotide
auuccguuuugguagcug

SEQ ID NO: 645 - RNA, 18 nt, Artificial Sequence
  Description of Artificial Sequence: Synthetic oligonucleotide
aguguauuccguuuuggu

SEQ ID NO: 646 - RNA, 18 nt, Artificial Sequence
  Description of Artificial Sequence: Synthetic oligonucleotide
uguuaaguguauuccguu

SEQ ID NO: 647 - RNA, 18 nt, Artificial Sequence
  Description of Artificial Sequence: Synthetic oligonucleotide
cuaucuguuaaguguauu

SEQ ID NO: 648 - RNA, 18 nt, Artificial Sequence
  Description of Artificial Sequence: Synthetic oligonucleotide
augaucuaucuguuaagu

SEQ ID NO: 649 - RNA, 18 nt, Artificial Sequence
  Description of Artificial Sequence: Synthetic oligonucleotide
ggaagaugaucuaucugu

SEQ ID NO: 650 - RNA, 18 nt, Artificial Sequence
  Description of Artificial Sequence: Synthetic oligonucleotide
guuuuggaagaugaucua

SEQ ID NO: 651 - RNA, 18 nt, Artificial Sequence
  Description of Artificial Sequence: Synthetic oligonucleotide
uauguguuuuggaagaug

SEQ ID NO: 652 - RNA, 18 nt, Artificial Sequence
  Description of Artificial Sequence: Synthetic oligonucleotide
aaguguauguguuuugga

SEQ ID NO: 653 - RNA, 18 nt, Artificial Sequence
  Description of Artificial Sequence: Synthetic oligonucleotide
guauuaaguguauguguu

SEQ ID NO: 654 - RNA, 18 nt, Artificial Sequence
  Description of Artificial Sequence: Synthetic oligonucleotide
uagguguauuaaguguau

SEQ ID NO: 655 - RNA, 18 nt, Artificial Sequence
  Description of Artificial Sequence: Synthetic oligonucleotide
ccaauuagguguauuaag

SEQ ID NO: 656 - RNA, 18 nt, Artificial Sequence
  Description of Artificial Sequence: Synthetic oligonucleotide
acaauccaauuaggugua

SEQ ID NO: 657 - RNA, 18 nt, Artificial Sequence
  Description of Artificial Sequence: Synthetic oligonucleotide
uaauuacaauccaauuag

SEQ ID NO: 658 - RNA, 18 nt, Artificial Sequence
  Description of Artificial Sequence: Synthetic oligonucleotide
ccaauuaauuacaaucca

SEQ ID NO: 659 - RNA, 18 nt, Artificial Sequence
  Description of Artificial Sequence: Synthetic oligonucleotide
cccuaccaauuaauuaca

SEQ ID NO: 660 - RNA, 18 nt, Artificial Sequence
  Description of Artificial Sequence: Synthetic oligonucleotide
uuaaucccuaccaauuaa

SEQ ID NO: 661 - RNA, 18 nt, Artificial Sequence
  Description of Artificial Sequence: Synthetic oligonucleotide
agcaguuaaucccuacca

SEQ ID NO: 662 - RNA, 18 nt, Artificial Sequence
  Description of Artificial Sequence: Synthetic oligonucleotide
ucagcagcaguuaauccc

SEQ ID NO: 663 - RNA, 18 nt, Artificial Sequence
  Description of Artificial Sequence: Synthetic oligonucleotide
agaacucagcagcaguua

SEQ ID NO: 664 - RNA, 18 nt, Artificial Sequence
  Description of Artificial Sequence: Synthetic oligonucleotide
auaauagaacucagcagc

SEQ ID NO: 665 - RNA, 18 nt, Artificial Sequence
  Description of Artificial Sequence: Synthetic oligonucleotide
uccaaauaauagaacuca

SEQ ID NO: 666 - RNA, 18 nt, Artificial Sequence
  Description of Artificial Sequence: Synthetic oligonucleotide
uuugauccaaauaauaga

SEQ ID NO: 667 - RNA, 18 nt, Artificial Sequence
  Description of Artificial Sequence: Synthetic oligonucleotide
caaacuuugauccaaaua

SEQ ID NO: 668 - RNA, 18 nt, Artificial Sequence
  Description of Artificial Sequence: Synthetic oligonucleotide
uuccccaaacuuugaucc

SEQ ID NO: 669 - RNA, 18 nt, Artificial Sequence
  Description of Artificial Sequence: Synthetic oligonucleotide
ugucauuccccaaacuuu

SEQ ID NO: 670 - RNA, 18 nt, Artificial Sequence
  Description of Artificial Sequence: Synthetic oligonucleotide
cuaaaugucauuccccaa

SEQ ID NO: 671 - RNA, 18 nt, Artificial Sequence
  Description of Artificial Sequence: Synthetic oligonucleotide
aaaaccuaaaugucauuc

SEQ ID NO: 672 - RNA, 18 nt, Artificial Sequence
  Description of Artificial Sequence: Synthetic oligonucleotide
auucuaaaaccuaaaugu

SEQ ID NO: 673 - RNA, 18 nt, Artificial Sequence
  Description of Artificial Sequence: Synthetic oligonucleotide
uucuaauucuaaaaccua

SEQ ID NO: 674 - RNA, 18 nt, Artificial Sequence
  Description of Artificial Sequence: Synthetic oligonucleotide
ccugguucuaauucuaaa

SEQ ID NO: 675 - RNA, 18 nt, Artificial Sequence
  Description of Artificial Sequence: Synthetic oligonucleotide
cuaugccugguucuaauu

SEQ ID NO: 676 - RNA, 18 nt, Artificial Sequence
  Description of Artificial Sequence: Synthetic oligonucleotide
uauccuuuuaagaauuuu

SEQ ID NO: 677 - RNA, 18 nt, Artificial Sequence
  Description of Artificial Sequence: Synthetic oligonucleotide
gcaacuauccuuuuaaga

SEQ ID NO: 678 - RNA, 18 nt, Artificial Sequence
  Description of Artificial Sequence: Synthetic oligonucleotide
ggguugcaacuauccuuu

SEQ ID NO: 679 - RNA, 18 nt, Artificial Sequence
  Description of Artificial Sequence: Synthetic oligonucleotide
aggcaggguugcaacuau

SEQ ID NO: 680 - RNA, 18 nt, Artificial Sequence
  Description of Artificial Sequence: Synthetic oligonucleotide
cauaaaggcaggguugca

SEQ ID NO: 681 - RNA, 18 nt, Artificial Sequence
  Description of Artificial Sequence: Synthetic oligonucleotide
ggauacauaaaggcaggg

SEQ ID NO: 682 - RNA, 18 nt, Artificial Sequence
  Description of Artificial Sequence: Synthetic oligonucleotide
uaccaggauacauaaagg

SEQ ID NO: 683 - RNA, 18 nt, Artificial Sequence
  Description of Artificial Sequence: Synthetic oligonucleotide
gauaguaccaggauacau

SEQ ID NO: 684 - RNA, 18 nt, Artificial Sequence
  Description of Artificial Sequence: Synthetic oligonucleotide
guaaggauaguaccagga

SEQ ID NO: 685 - RNA, 18 nt, Artificial Sequence
  Description of Artificial Sequence: Synthetic oligonucleotide
acaauguaaggauaguac

SEQ ID NO: 686 - RNA, 18 nt, Artificial Sequence
  Description of Artificial Sequence: Synthetic oligonucleotide
uuguaacaauguaaggau

SEQ ID NO: 687 - RNA, 18 nt, Artificial Sequence
  Description of Artificial Sequence: Synthetic oligonucleotide
cuuuauuguaacaaugua

SEQ ID NO: 688 - RNA, 18 nt, Artificial Sequence
  Description of Artificial Sequence: Synthetic oligonucleotide
uuucucuuuauuguaaca

SEQ ID NO: 689 - RNA, 18 nt, Artificial Sequence
  Description of Artificial Sequence: Synthetic oligonucleotide
uaagauuucucuuuauug

SEQ ID NO: 690 - RNA, 18 nt, Artificial Sequence
  Description of Artificial Sequence: Synthetic oligonucleotide
aaauuuaagauuucucuu

SEQ ID NO: 691 - RNA, 18 nt, Artificial Sequence
  Description of Artificial Sequence: Synthetic oligonucleotide
auugaaaauuuaagauuu

SEQ ID NO: 692 - RNA, 18 nt, Artificial Sequence
  Description of Artificial Sequence: Synthetic oligonucleotide
aagugauugaaaauuuaa

SEQ ID NO: 693 - RNA, 18 nt, Artificial Sequence
  Description of Artificial Sequence: Synthetic oligonucleotide
gaucaaagugauugaaaa

SEQ ID NO: 694 - RNA, 18 nt, Artificial Sequence
  Description of Artificial Sequence: Synthetic oligonucleotide
agggugaucaaagugauu

SEQ ID NO: 695 - RNA, 18 nt, Artificial Sequence
  Description of Artificial Sequence: Synthetic oligonucleotide
ucugcagggugaucaaag

SEQ ID NO: 696 - RNA, 18 nt, Artificial Sequence
  Description of Artificial Sequence: Synthetic oligonucleotide
auuuaucugcagggugau

SEQ ID NO: 697 - RNA, 18 nt, Artificial Sequence
  Description of Artificial Sequence: Synthetic oligonucleotide
cuaaaauuuaucugcagg

SEQ ID NO: 698 - RNA, 18 nt, Artificial Sequence
  Description of Artificial Sequence: Synthetic oligonucleotide
aucugcuaaaauuuaucu

SEQ ID NO: 699 - RNA, 18 nt, Artificial Sequence
  Description of Artificial Sequence: Synthetic oligonucleotide
ggaucaucugcuaaaauu

SEQ ID NO: 700 - RNA, 18 nt, Artificial Sequence
  Description of Artificial Sequence: Synthetic oligonucleotide
ucuaaggaucaucugcua

SEQ ID NO: 701 - RNA, 18 nt, Artificial Sequence
  Description of Artificial Sequence: Synthetic oligonucleotide
uuagaucuaaggaucauc

SEQ ID NO: 702 - RNA, 18 nt, Artificial Sequence
  Description of Artificial Sequence: Synthetic oligonucleotide
acaacuuagaucuaagga

SEQ ID NO: 703 - RNA, 18 nt, Artificial Sequence
  Description of Artificial Sequence: Synthetic oligonucleotide
uaauuacaacuuagaucu

SEQ ID NO: 704 - RNA, 18 nt, Artificial Sequence
  Description of Artificial Sequence: Synthetic oligonucleotide
ccaaauaauuacaacuua

SEQ ID NO: 705 - RNA, 18 nt, Artificial Sequence
  Description of Artificial Sequence: Synthetic oligonucleotide
aucagccaaauaauuaca

SEQ ID NO: 706 - RNA, 18 nt, Artificial Sequence
  Description of Artificial Sequence: Synthetic oligonucleotide
gcucuaucagccaaauaa

SEQ ID NO: 707 - RNA, 18 nt, Artificial Sequence
  Description of Artificial Sequence: Synthetic oligonucleotide
caauagcucuaucagcca

SEQ ID NO: 708 - RNA, 18 nt, Artificial Sequence
  Description of Artificial Sequence: Synthetic oligonucleotide
ugggucaauagcucuauc

SEQ ID NO: 709 - RNA, 18 nt, Artificial Sequence
  Description of Artificial Sequence: Synthetic oligonucleotide
acacaugggucaauagcu

SEQ ID NO: 710 - RNA, 18 nt, Artificial Sequence
  Description of Artificial Sequence: Synthetic oligonucleotide
ugccaacacaugggucaa

SEQ ID NO: 711 - RNA, 18 nt, Artificial Sequence
  Description of Artificial Sequence: Synthetic oligonucleotide
acaaaugccaacacaugg

SEQ ID NO: 712 - RNA, 18 nt, Artificial Sequence
  Description of Artificial Sequence: Synthetic oligonucleotide
gucuuacaaaugccaaca

SEQ ID NO: 713 - RNA, 18 nt, Artificial Sequence
  Description of Artificial Sequence: Synthetic oligonucleotide
agaaagucuuacaaaugc

SEQ ID NO: 714 - RNA, 18 nt, Artificial Sequence
  Description of Artificial Sequence: Synthetic oligonucleotide
uuuuuagaaagucuuaca

SEQ ID NO: 715 - RNA, 18 nt, Artificial Sequence
  Description of Artificial Sequence: Synthetic oligonucleotide
agcacuuuuuagaaaguc

SEQ ID NO: 716 - RNA, 18 nt, Artificial Sequence
  Description of Artificial Sequence: Synthetic oligonucleotide
gcuggagcacuuuuuaga

SEQ ID NO: 717 - RNA, 18 nt, Artificial Sequence
  Description of Artificial Sequence: Synthetic oligonucleotide
aauuugcuggagcacuuu

SEQ ID NO: 718 - RNA, 18 nt, Artificial Sequence
  Description of Artificial Sequence: Synthetic oligonucleotide
auuaaaauuugcuggagc

SEQ ID NO: 719 - RNA, 18 nt, Artificial Sequence
  Description of Artificial Sequence: Synthetic oligonucleotide
gcaguauuaaaauuugcu

SEQ ID NO: 720 - RNA, 18 nt, Artificial Sequence
  Description of Artificial Sequence: Synthetic oligonucleotide
uuaaagcaguauuaaaau

SEQ ID NO: 721 - RNA, 18 nt, Artificial Sequence
  Description of Artificial Sequence: Synthetic oligonucleotide
gauauuuaaagcaguauu

SEQ ID NO: 722 - RNA, 18 nt, Artificial Sequence
  Description of Artificial Sequence: Synthetic oligonucleotide
gucaugauauuuaaagca

SEQ ID NO: 723 - RNA, 18 nt, Artificial Sequence
  Description of Artificial Sequence: Synthetic oligonucleotide
auggugucaugauauuua

SEQ ID NO: 724 - RNA, 18 nt, Artificial Sequence
  Description of Artificial Sequence: Synthetic oligonucleotide
aguucauggugucaugau

SEQ ID NO: 725 - RNA, 18 nt, Artificial Sequence
  Description of Artificial Sequence: Synthetic oligonucleotide
uuuagaguucaugguguc

SEQ ID NO: 726 - RNA, 18 nt, Artificial Sequence
  Description of Artificial Sequence: Synthetic oligonucleotide
aauucuuuagaguucaug

SEQ ID NO: 727 - RNA, 18 nt, Artificial Sequence
  Description of Artificial Sequence: Synthetic oligonucleotide
uuuucaauucuuuagagu

SEQ ID NO: 728 - RNA, 18 nt, Artificial Sequence
  Description of Artificial Sequence: Synthetic oligonucleotide
agcacuuuucaauucuuu

SEQ ID NO: 729 - RNA, 18 nt, Artificial Sequence
  Description of Artificial Sequence: Synthetic oligonucleotide
ucacaagcacuuuucaau

SEQ ID NO: 730 - RNA, 18 nt, Artificial Sequence
  Description of Artificial Sequence: Synthetic oligonucleotide
ccaacucacaagcacuuu

SEQ ID NO: 731 - RNA, 18 nt, Artificial Sequence
  Description of Artificial Sequence: Synthetic oligonucleotide
gauaaccaacucacaagc

SEQ ID NO: 732 - RNA, 18 nt, Artificial Sequence
  Description of Artificial Sequence: Synthetic oligonucleotide
cccuugauaaccaacuca

SEQ ID NO: 733 - RNA, 18 nt, Artificial Sequence
  Description of Artificial Sequence: Synthetic oligonucleotide
uccuccccuugauaacca

SEQ ID NO: 734 - RNA, 18 nt, Artificial Sequence
  Description of Artificial Sequence: Synthetic oligonucleotide
auauauccuccccuugau

SEQ ID NO: 735 - RNA, 18 nt, Artificial Sequence
  Description of Artificial Sequence: Synthetic oligonucleotide
auuugauauauccucccc

SEQ ID NO: 736 - RNA, 18 nt, Artificial Sequence
  Description of Artificial Sequence: Synthetic oligonucleotide
uggccauuugauauaucc

SEQ ID NO: 737 - RNA, 18 nt, Artificial Sequence
  Description of Artificial Sequence: Synthetic oligonucleotide
caaaauggccauuugaua

SEQ ID NO: 738 - RNA, 18 nt, Artificial Sequence
  Description of Artificial Sequence: Synthetic oligonucleotide
uugaacaaaauggccauu

SEQ ID NO: 739 - RNA, 18 nt, Artificial Sequence
  Description of Artificial Sequence: Synthetic oligonucleotide
acauauugaacaaaaugg

SEQ ID NO: 740 - RNA, 18 nt, Artificial Sequence
  Description of Artificial Sequence: Synthetic oligonucleotide
agaacacauauugaacaa

SEQ ID NO: 741 - RNA, 18 nt, Artificial Sequence
  Description of Artificial Sequence: Synthetic oligonucleotide
uuucuagaacacauauug

SEQ ID NO: 742 - RNA, 18 nt, Artificial Sequence
  Description of Artificial Sequence: Synthetic oligonucleotide
uuucauuucuagaacaca

SEQ ID NO: 743 - RNA, 18 nt, Artificial Sequence
  Description of Artificial Sequence: Synthetic oligonucleotide
uggcuuuucauuucuaga

SEQ ID NO: 744 - RNA, 18 nt, Artificial Sequence
  Description of Artificial Sequence: Synthetic oligonucleotide
uaguauggcuuuucauuu

SEQ ID NO: 745 - RNA, 18 nt, Artificial Sequence
  Description of Artificial Sequence: Synthetic oligonucleotide
uauuuuaguauggcuuuu

SEQ ID NO: 746 - RNA, 18 nt, Artificial Sequence
  Description of Artificial Sequence: Synthetic oligonucleotide
gacaguauuuuaguaugg

SEQ ID NO: 747 - RNA, 18 nt, Artificial Sequence
  Description of Artificial Sequence: Synthetic oligonucleotide
accaagacaguauuuuag

SEQ ID NO: 748 - RNA, 18 nt, Artificial Sequence
  Description of Artificial Sequence: Synthetic oligonucleotide
uuuggaccaagacaguau

SEQ ID NO: 749 - RNA, 18 nt, Artificial Sequence
  Description of Artificial Sequence: Synthetic oligonucleotide
cagauuuuggaccaagac

SEQ ID NO: 750 - RNA, 18 nt, Artificial Sequence
  Description of Artificial Sequence: Synthetic oligonucleotide
uuacacagauuuuggacc

SEQ ID NO: 751 - RNA, 18 nt, Artificial Sequence
  Description of Artificial Sequence: Synthetic oligonucleotide
aaauuuuacacagauuuu

SEQ ID NO: 752 - RNA, 18 nt, Artificial Sequence
  Description of Artificial Sequence: Synthetic oligonucleotide
aaaacaaauuuuacacag

SEQ ID NO: 753 - RNA, 18 nt, Artificial Sequence
  Description of Artificial Sequence: Synthetic oligonucleotide
auuucaaaacaaauuuua

SEQ ID NO: 754 - RNA, 18 nt, Artificial Sequence
  Description of Artificial Sequence: Synthetic oligonucleotide
aagacauuucaaaacaaa

SEQ ID NO: 755 - RNA, 18 nt, Artificial Sequence
  Description of Artificial Sequence: Synthetic oligonucleotide
uuugaaagacauuucaaa

SEQ ID NO: 756 - RNA, 18 nt, Artificial Sequence
  Description of Artificial Sequence: Synthetic oligonucleotide
auauuuuugaaagacauu

SEQ ID NO: 757 - RNA, 18 nt, Artificial Sequence
  Description of Artificial Sequence: Synthetic oligonucleotide
agggaauauuuuugaaag

SEQ ID NO: 758 - RNA, 18 nt, Artificial Sequence
  Description of Artificial Sequence: Synthetic oligonucleotide
ucaaaagggaauauuuuu

SEQ ID NO: 759 - RNA, 18 nt, Artificial Sequence
  Description of Artificial Sequence: Synthetic oligonucleotide
aauuuucaaaagggaaua

SEQ ID NO: 760 - RNA, 18 nt, Artificial Sequence
  Description of Artificial Sequence: Synthetic oligonucleotide
gauauaauuuucaaaagg

SEQ ID NO: 761 - RNA, 18 nt, Artificial Sequence
  Description of Artificial Sequence: Synthetic oligonucleotide
uuacugauauaauuuuca

SEQ ID NO: 762 - RNA, 18 nt, Artificial Sequence
  Description of Artificial Sequence: Synthetic oligonucleotide
uauucuuacugauauaau

SEQ ID NO: 763 - RNA, 18 nt, Artificial Sequence
  Description of Artificial Sequence: Synthetic oligonucleotide
auaaauauucuuacugau

SEQ ID NO: 764 - RNA, 18 nt, Artificial Sequence
  Description of Artificial Sequence: Synthetic oligonucleotide
guuuaauaaauauucuua

SEQ ID NO: 765 - RNA, 18 nt, Artificial Sequence
  Description of Artificial Sequence: Synthetic oligonucleotide
cugauguuuaauaaauau

SEQ ID NO: 766 - RNA, 18 nt, Artificial Sequence
  Description of Artificial Sequence: Synthetic oligonucleotide
uagaccugauguuuaaua

SEQ ID NO: 767 - RNA, 18 nt, Artificial Sequence
  Description of Artificial Sequence: Synthetic oligonucleotide
uaauuuagaccugauguu

SEQ ID NO: 768 - RNA, 18 nt, Artificial Sequence
  Description of Artificial Sequence: Synthetic oligonucleotide
aaaaauaauuuagaccug

SEQ ID NO: 769 - RNA, 18 nt, Artificial Sequence
  Description of Artificial Sequence: Synthetic oligonucleotide
ggaguaaaaauaauuuag

SEQ ID NO: 770 - RNA, 18 nt, Artificial Sequence
  Description of Artificial Sequence: Synthetic oligonucleotide
acuuuggaguaaaaauaa

SEQ ID NO: 771 - RNA, 18 nt, Artificial Sequence
  Description of Artificial Sequence: Synthetic oligonucleotide
guuuuacuuuggaguaaa

SEQ ID NO: 772 - RNA, 18 nt, Artificial Sequence
  Description of Artificial Sequence: Synthetic oligonucleotide
ugcauguuuuacuuugga

SEQ ID NO: 773 - RNA, 18 nt, Artificial Sequence
  Description of Artificial Sequence: Synthetic oligonucleotide
uccauccuuugaaugugg

SEQ ID NO: 774 - RNA, 18 nt, Artificial Sequence
  Description of Artificial Sequence: Synthetic oligonucleotide
auccauccauccuuugaa

SEQ ID NO: 775 - RNA, 18 nt, Artificial Sequence
  Description of Artificial Sequence: Synthetic oligonucleotide
auuauauccauccauccu

SEQ ID NO: 776 - RNA, 18 nt, Artificial Sequence
  Description of Artificial Sequence: Synthetic oligonucleotide
cauacauuauauccaucc

SEQ ID NO: 777 - RNA, 18 nt, Artificial Sequence
  Description of Artificial Sequence: Synthetic oligonucleotide
ugcugcauacauuauauc

SEQ ID NO: 778 - RNA, 18 nt, Artificial Sequence
  Description of Artificial Sequence: Synthetic oligonucleotide
ucaacugcugcauacauu

SEQ ID NO: 779 - RNA, 18 nt, Artificial Sequence
  Description of Artificial Sequence: Synthetic oligonucleotide
uggaaucaacugcugcau

SEQ ID NO: 780 - RNA, 18 nt, Artificial Sequence
  Description of Artificial Sequence: Synthetic oligonucleotide
auuucuggaaucaacugc

SEQ ID NO: 781 - RNA, 18 nt, Artificial Sequence
  Description of Artificial Sequence: Synthetic oligonucleotide
aaagggcauucacaacca

SEQ ID NO: 782 - RNA, 18 nt, Artificial Sequence
  Description of Artificial Sequence: Synthetic oligonucleotide
uccuaaaagggcauucac

SEQ ID NO: 783 - RNA, 18 nt, Artificial Sequence
  Description of Artificial Sequence: Synthetic oligonucleotide
auugcuccuaaaagggca

SEQ ID NO: 784 - RNA, 18 nt, Artificial Sequence
  Description of Artificial Sequence: Synthetic oligonucleotide
auggaauugcuccuaaaa

SEQ ID NO: 785 - RNA, 18 nt, Artificial Sequence
  Description of Artificial Sequence: Synthetic oligonucleotide
gauggauggaauugcucc

SEQ ID NO: 786 - RNA, 18 nt, Artificial Sequence
  Description of Artificial Sequence: Synthetic oligonucleotide
uucaugauggauggaauu

SEQ ID NO: 787 - RNA, 18 nt, Artificial Sequence
  Description of Artificial Sequence: Synthetic oligonucleotide
gcacauucaugauggaug

SEQ ID NO: 788 - RNA, 18 nt, Artificial Sequence
  Description of Artificial Sequence: Synthetic oligonucleotide
cagaagcacauucaugau

SEQ ID NO: 789 - RNA, 18 nt, Artificial Sequence
  Description of Artificial Sequence: Synthetic oligonucleotide
caaaccagaagcacauuc

SEQ ID NO: 790 - RNA, 18 nt, Artificial Sequence
  Description of Artificial Sequence: Synthetic oligonucleotide
uaagacaaaccagaagca

SEQ ID NO: 791 - RNA, 18 nt, Artificial Sequence
  Description of Artificial Sequence: Synthetic oligonucleotide
gaauauaagacaaaccag

SEQ ID NO: 792 - RNA, 18 nt, Artificial Sequence
  Description of Artificial Sequence: Synthetic oligonucleotide
agccagaauauaagacaa

SEQ ID NO: 793 - RNA, 18 nt, Artificial Sequence
  Description of Artificial Sequence: Synthetic oligonucleotide
aaauuagccagaauauaa

SEQ ID NO: 794 - RNA, 18 nt, Artificial Sequence
  Description of Artificial Sequence: Synthetic oligonucleotide
gcugaaaauuagccagaa

SEQ ID NO: 795 - RNA, 18 nt, Artificial Sequence
  Description of Artificial Sequence: Synthetic oligonucleotide
augaugcugaaaauuagc

SEQ ID NO: 796 - RNA, 18 nt, Artificial Sequence
  Description of Artificial Sequence: Synthetic oligonucleotide
cgcccaugaugcugaaaa

SEQ ID NO: 797 - RNA, 18 nt, Artificial Sequence
  Description of Artificial Sequence: Synthetic oligonucleotide
auuuacgcccaugaugcu

SEQ ID NO: 798 - RNA, 18 nt, Artificial Sequence
  Description of Artificial Sequence: Synthetic oligonucleotide
aacaaauuuacgcccaug

SEQ ID NO: 799 - RNA, 18 nt, Artificial Sequence
  Description of Artificial Sequence: Synthetic oligonucleotide
cagcaaacaaauuuacgc

SEQ ID NO: 800 - RNA, 18 nt, Artificial Sequence
  Description of Artificial Sequence: Synthetic oligonucleotide
uuugccagcaaacaaauu

SEQ ID NO: 801 - RNA, 18 nt, Artificial Sequence
  Description of Artificial Sequence: Synthetic oligonucleotide
uagaauuugccagcaaac

SEQ ID NO: 802 - RNA, 18 nt, Artificial Sequence
  Description of Artificial Sequence: Synthetic oligonucleotide
agugguagaauuugccag

SEQ ID NO: 803 - RNA, 18 nt, Artificial Sequence
  Description of Artificial Sequence: Synthetic oligonucleotide
aauacagugguagaauuu

SEQ ID NO: 804 - RNA, 18 nt, Artificial Sequence
  Description of Artificial Sequence: Synthetic oligonucleotide
guguuaauacagugguag

SEQ ID NO: 805 - RNA, 18 nt, Artificial Sequence
  Description of Artificial Sequence: Synthetic oligonucleotide
uugugguguuaauacagu

SEQ ID NO: 806 - RNA, 18 nt, Artificial Sequence
  Description of Artificial Sequence: Synthetic oligonucleotide
accaguugugguguuaau

SEQ ID NO: 807 - RNA, 18 nt, Artificial Sequence
  Description of Artificial Sequence: Synthetic oligonucleotide
cugucaccaguuguggug

SEQ ID NO: 808 - RNA, 18 nt, Artificial Sequence
  Description of Artificial Sequence: Synthetic oligonucleotide
caaaccugucaccaguug

SEQ ID NO: 809 - RNA, 18 nt, Artificial Sequence
  Description of Artificial Sequence: Synthetic oligonucleotide
gaugucaaaccugucacc

SEQ ID NO: 810 - RNA, 18 nt, Artificial Sequence
  Description of Artificial Sequence: Synthetic oligonucleotide
ucuucgaugucaaaccug

SEQ ID NO: 811 - RNA, 18 nt, Artificial Sequence
  Description of Artificial Sequence: Synthetic oligonucleotide
ucacgucuucgaugucaa

SEQ ID NO: 812 - RNA, 18 nt, Artificial Sequence
  Description of Artificial Sequence: Synthetic oligonucleotide
auuauucacgucuucgau

SEQ ID NO: 813 - RNA, 18 nt, Artificial Sequence
  Description of Artificial Sequence: Synthetic oligonucleotide
guaugauuauucacgucu

SEQ ID NO: 814 - RNA, 18 nt, Artificial Sequence
  Description of Artificial Sequence: Synthetic oligonucleotide
aaucaguaugauuauuca

SEQ ID NO: 815 - RNA, 18 nt, Artificial Sequence
  Description of Artificial Sequence: Synthetic oligonucleotide
uaggcaaucaguaugauu

SEQ ID NO: 816 - RNA, 18 nt, Artificial Sequence
  Description of Artificial Sequence: Synthetic oligonucleotide
aguuuuaggcaaucagua

SEQ ID NO: 817 - RNA, 18 nt, Artificial Sequence
  Description of Artificial Sequence: Synthetic oligonucleotide
cuauuaguuuuaggcaau

SEQ ID NO: 818 - RNA, 18 nt, Artificial Sequence
  Description of Artificial Sequence: Synthetic oligonucleotide
ucuuucuauuaguuuuag

SEQ ID NO: 819 - RNA, 18 nt, Artificial Sequence
  Description of Artificial Sequence: Synthetic oligonucleotide
ucauuucuuucuauuagu

SEQ ID NO: 820 - RNA, 18 nt, Artificial Sequence
  Description of Artificial Sequence: Synthetic oligonucleotide
cagucucauuucuuucua

SEQ ID NO: 821 - RNA, 18 nt, Artificial Sequence
  Description of Artificial Sequence: Synthetic oligonucleotide
ucgagcagucucauuucu

SEQ ID NO: 822 - RNA, 18 nt, Artificial Sequence
  Description of Artificial Sequence: Synthetic oligonucleotide
uuccaucgagcagucuca

SEQ ID NO: 823 - RNA, 18 nt, Artificial Sequence
  Description of Artificial Sequence: Synthetic oligonucleotide
cauuuuuccaucgagcag

SEQ ID NO: 824 - RNA, 18 nt, Artificial Sequence
  Description of Artificial Sequence: Synthetic oligonucleotide
uuucacauuuuuccaucg

SEQ ID NO: 825 - RNA, 18 nt, Artificial Sequence
  Description of Artificial Sequence: Synthetic oligonucleotide
uuuacuuucacauuuuuc

SEQ ID NO: 826 - RNA, 18 nt, Artificial Sequence
  Description of Artificial Sequence: Synthetic oligonucleotide
caaaguuuacuuucacau

SEQ ID NO: 827 - RNA, 18 nt, Artificial Sequence
  Description of Artificial Sequence: Synthetic oligonucleotide
auuaucaaaguuuacuuu

SEQ ID NO: 828 - RNA, 18 nt, Artificial Sequence
  Description of Artificial Sequence: Synthetic oligonucleotide
ccuacauuaucaaaguuu

SEQ ID NO: 829 - RNA, 18 nt, Artificial Sequence
  Description of Artificial Sequence: Synthetic oligonucleotide
caaauccuacauuaucaa

SEQ ID NO: 830 - RNA, 18 nt, Artificial Sequence
  Description of Artificial Sequence: Synthetic oligonucleotide
auacccaaauccuacauu

SEQ ID NO: 831 - RNA, 18 nt, Artificial Sequence
  Description of Artificial Sequence: Synthetic oligonucleotide
gagagauacccaaauccu

SEQ ID NO: 832 - RNA, 18 nt, Artificial Sequence
  Description of Artificial Sequence: Synthetic oligonucleotide
gcaaagagagauacccaa

SEQ ID NO: 833 - RNA, 18 nt, Artificial Sequence
  Description of Artificial Sequence: Synthetic oligonucleotide
uugaagcaaagagagaua

SEQ ID NO: 834 - RNA, 18 nt, Artificial Sequence
  Description of Artificial Sequence: Synthetic oligonucleotide
cagagaaaauaguguuca

SEQ ID NO: 835 - RNA, 18 nt, Artificial Sequence
  Description of Artificial Sequence: Synthetic oligonucleotide
auauucagagaaaauagu

SEQ ID NO: 836 - RNA, 18 nt, Artificial Sequence
  Description of Artificial Sequence: Synthetic oligonucleotide
uaaaaauauucagagaaa

SEQ ID NO: 837 - RNA, 18 nt, Artificial Sequence
  Description of Artificial Sequence: Synthetic oligonucleotide
aacaauaaaaauauucag

SEQ ID NO: 838 - RNA, 18 nt, Artificial Sequence
  Description of Artificial Sequence: Synthetic oligonucleotide
uuccaaacaauaaaaaua

SEQ ID NO: 839 - RNA, 18 nt, Artificial Sequence
  Description of Artificial Sequence: Synthetic oligonucleotide
uauuauuccaaacaauaa

SEQ ID NO: 840 - RNA, 18 nt, Artificial Sequence
  Description of Artificial Sequence: Synthetic oligonucleotide
uuuguuauuauuccaaac

SEQ ID NO: 841 - RNA, 18 nt, Artificial Sequence
  Description of Artificial Sequence: Synthetic oligonucleotide
auuauuuuguuauuauuc

SEQ ID NO: 842 - RNA, 18 nt, Artificial Sequence
  Description of Artificial Sequence: Synthetic oligonucleotide
augucauuauuuuguuau

SEQ ID NO: 843 - RNA, 18 nt, Artificial Sequence
  Description of Artificial Sequence: Synthetic oligonucleotide
gauguaugucauuauuuu

SEQ ID NO: 844 - RNA, 18 nt, Artificial Sequence
  Description of Artificial Sequence: Synthetic oligonucleotide
uaauagauguaugucauu

SEQ ID NO: 845 - RNA, 18 nt, Artificial Sequence
  Description of Artificial Sequence: Synthetic oligonucleotide
cuaaauaauagauguaug

SEQ ID NO: 846 - RNA, 18 nt, Artificial Sequence
  Description of Artificial Sequence: Synthetic oligonucleotide
aggaacuaaauaauagau

SEQ ID NO: 847 - RNA, 18 nt, Artificial Sequence
  Description of Artificial Sequence: Synthetic oligonucleotide
uucuuaggaacuaaauaa

SEQ ID NO: 848 - RNA, 18 nt, Artificial Sequence
  Description of Artificial Sequence: Synthetic oligonucleotide
acuuuuucuuaggaacua

SEQ ID NO: 849 - RNA, 18 nt, Artificial Sequence
  Description of Artificial Sequence: Synthetic oligonucleotide
uauauacuuuuucuuagg

SEQ ID NO: 850 - RNA, 18 nt, Artificial Sequence
  Description of Artificial Sequence: Synthetic oligonucleotide
agaaauauauacuuuuuc

SEQ ID NO: 851 - RNA, 18 nt, Artificial Sequence
  Description of Artificial Sequence: Synthetic oligonucleotide
uagaaagaaauauauacu

SEQ ID NO: 852 - RNA, 18 nt, Artificial Sequence
  Description of Artificial Sequence: Synthetic oligonucleotide
uuaaauagaaagaaauau

SEQ ID NO: 853 - RNA, 18 nt, Artificial Sequence
  Description of Artificial Sequence: Synthetic oligonucleotide
auuuuuuaaauagaaaga

SEQ ID NO: 854 - RNA, 18 nt, Artificial Sequence
  Description of Artificial Sequence: Synthetic oligonucleotide
uugaaauuuuuuaaauag

SEQ ID NO: 855 - RNA, 18 nt, Artificial Sequence
  Description of Artificial Sequence: Synthetic oligonucleotide
acaaauugaaauuuuuua

SEQ ID NO: 856 - RNA, 18 nt, Artificial Sequence
  Description of Artificial Sequence: Synthetic oligonucleotide
uacuaacaaauugaaauu

SEQ ID NO: 857 - RNA, 18 nt, Artificial Sequence
  Description of Artificial Sequence: Synthetic oligonucleotide
acuuguacuaacaaauug

SEQ ID NO: 858 - RNA, 18 nt, Artificial Sequence
  Description of Artificial Sequence: Synthetic oligonucleotide
cauaaacuuguacuaaca

SEQ ID NO: 859 - RNA, 18 nt, Artificial Sequence
  Description of Artificial Sequence: Synthetic oligonucleotide
gggcucauaaacuuguac

SEQ ID NO: 860 - RNA, 18 nt, Artificial Sequence
  Description of Artificial Sequence: Synthetic oligonucleotide
caucugggcucauaaacu

SEQ ID NO: 861 - RNA, 18 nt, Artificial Sequence
  Description of Artificial Sequence: Synthetic oligonucleotide
ucacccaucugggcucau

SEQ ID NO: 862 - RNA, 18 nt, Artificial Sequence
  Description of Artificial Sequence: Synthetic oligonucleotide
aguuuucacccaucuggg

SEQ ID NO: 863 - RNA, 18 nt, Artificial Sequence
  Description of Artificial Sequence: Synthetic oligonucleotide
aauaaaguuuucacccau

SEQ ID NO: 864 - RNA, 18 nt, Artificial Sequence
  Description of Artificial Sequence: Synthetic oligonucleotide
cauguaauaaaguuuuca

SEQ ID NO: 865 - RNA, 18 nt, Artificial Sequence
  Description of Artificial Sequence: Synthetic oligonucleotide
ccuuacauguaauaaagu

SEQ ID NO: 866 - RNA, 18 nt, Artificial Sequence
  Description of Artificial Sequence: Synthetic oligonucleotide
gcaguccuuacauguaau

SEQ ID NO: 867 - RNA, 18 nt, Artificial Sequence
  Description of Artificial Sequence: Synthetic oligonucleotide
uaucugcaguccuuacau

SEQ ID NO: 868 - RNA, 18 nt, Artificial Sequence
  Description of Artificial Sequence: Synthetic oligonucleotide
gacuauaucugcaguccu

SEQ ID NO: 869 - RNA, 18 nt, Artificial Sequence
  Description of Artificial Sequence: Synthetic oligonucleotide
cuacugacuauaucugca

SEQ ID NO: 870 - RNA, 18 nt, Artificial Sequence
  Description of Artificial Sequence: Synthetic oligonucleotide
ggucacuacugacuauau

SEQ ID NO: 871 - RNA, 18 nt, Artificial Sequence
  Description of Artificial Sequence: Synthetic oligonucleotide
ggucuggucacuacugac

SEQ ID NO: 872 - RNA, 18 nt, Artificial Sequence
  Description of Artificial Sequence: Synthetic oligonucleotide
uguuuggucuggucacua

SEQ ID NO: 873 - RNA, 18 nt, Artificial Sequence
  Description of Artificial Sequence: Synthetic oligonucleotide
gucuuuguuuggucuggu

SEQ ID NO: 874 - RNA, 18 nt, Artificial Sequence
  Description of Artificial Sequence: Synthetic oligonucleotide
aagaggucuuuguuuggu

SEQ ID NO: 875 - RNA, 18 nt, Artificial Sequence
  Description of Artificial Sequence: Synthetic oligonucleotide
agacaaagaggucuuugu

SEQ ID NO: 876 - RNA, 18 nt, Artificial Sequence
  Description of Artificial Sequence: Synthetic oligonucleotide
aaaaaagacaaagagguc

SEQ ID NO: 877 - RNA, 18 nt, Artificial Sequence
  Description of Artificial Sequence: Synthetic oligonucleotide
acaagaaaaaagacaaag

SEQ ID NO: 878 - RNA, 18 nt, Artificial Sequence
  Description of Artificial Sequence: Synthetic oligonucleotide
aaaauacaagaaaaaaga

SEQ ID NO: 879 - RNA, 18 nt, Artificial Sequence
  Description of Artificial Sequence: Synthetic oligonucleotide
caaagaaaauacaagaaa

SEQ ID NO: 880 - RNA, 18 nt, Artificial Sequence
  Description of Artificial Sequence: Synthetic oligonucleotide
agaaacaaagaaaauaca

SEQ ID NO: 881 - RNA, 18 nt, Artificial Sequence
  Description of Artificial Sequence: Synthetic oligonucleotide
aauauagaaacaaagaaa

SEQ ID NO: 882 - RNA, 18 nt, Artificial Sequence
  Description of Artificial Sequence: Synthetic oligonucleotide
agagcaauauagaaacaa

SEQ ID NO: 883 - RNA, 18 nt, Artificial Sequence
  Description of Artificial Sequence: Synthetic oligonucleotide
uagaaagagcaauauaga

SEQ ID NO: 884 - RNA, 18 nt, Artificial Sequence
  Description of Artificial Sequence: Synthetic oligonucleotide
uuauauagaaagagcaau

SEQ ID NO: 885 - RNA, 18 nt, Artificial Sequence
  Description of Artificial Sequence: Synthetic oligonucleotide
cuuguuuauauagaaaga

SEQ ID NO: 886 - RNA, 18 nt, Artificial Sequence
  Description of Artificial Sequence: Synthetic oligonucleotide
auuuacuuguuuauauag

SEQ ID NO: 887 - RNA, 18 nt, Artificial Sequence
  Description of Artificial Sequence: Synthetic oligonucleotide
uauuaauuuacuuguuua

SEQ ID NO: 888 - RNA, 18 nt, Artificial Sequence
  Description of Artificial Sequence: Synthetic oligonucleotide
ugauuuauuaauuuacuu

SEQ ID NO: 889 - RNA, 18 nt, Artificial Sequence
  Description of Artificial Sequence: Synthetic oligonucleotide
guuacugauuuauuaauu

SEQ ID NO: 890 - RNA, 18 nt, Artificial Sequence
  Description of Artificial Sequence: Synthetic oligonucleotide
gcaaaguuacugauuuau

SEQ ID NO: 891 - RNA, 18 nt, Artificial Sequence
  Description of Artificial Sequence: Synthetic oligonucleotide
aaauggcaaaguuacuga

SEQ ID NO: 892 - RNA, 18 nt, Artificial Sequence
  Description of Artificial Sequence: Synthetic oligonucleotide
auaaaaaauggcaaaguu

SEQ ID NO: 893 - RNA, 18 nt, Artificial Sequence
  Description of Artificial Sequence: Synthetic oligonucleotide
ucacaauaaaaaauggca

SEQ ID NO: 894 - RNA, 18 nt, Artificial Sequence
  Description of Artificial Sequence: Synthetic oligonucleotide
ucuaaucacaauaaaaaa

SEQ ID NO: 895 - RNA, 18 nt, Artificial Sequence
  Description of Artificial Sequence: Synthetic oligonucleotide
agccuucuaaucacaaua

SEQ ID NO: 896 - RNA, 18 nt, Artificial Sequence
  Description of Artificial Sequence: Synthetic oligonucleotide
aaacaagccuucuaauca

SEQ ID NO: 897 - RNA, 18 nt, Artificial Sequence
  Description of Artificial Sequence: Synthetic oligonucleotide
cagggaaacaagccuucu

SEQ ID NO: 898 - RNA, 18 nt, Artificial Sequence
  Description of Artificial Sequence: Synthetic oligonucleotide
cugaucagggaaacaagc

SEQ ID NO: 899 - RNA, 18 nt, Artificial Sequence
  Description of Artificial Sequence: Synthetic oligonucleotide
gguagcugaucagggaaa

SEQ ID NO: 900 - RNA, 18 nt, Artificial Sequence
  Description of Artificial Sequence: Synthetic oligonucleotide
guuuugguagcugaucag

SEQ ID NO: 901 - RNA, 18 nt, Artificial Sequence
  Description of Artificial Sequence: Synthetic oligonucleotide
auuccguuuugguagcug

SEQ ID NO: 902 - RNA, 18 nt, Artificial Sequence
  Description of Artificial Sequence: Synthetic oligonucleotide
aguguauuccguuuuggu

SEQ ID NO: 903 - RNA, 18 nt, Artificial Sequence
  Description of Artificial Sequence: Synthetic oligonucleotide
uguuaaguguauuccguu

SEQ ID NO: 904 - RNA, 18 nt, Artificial Sequence
  Description of Artificial Sequence: Synthetic oligonucleotide
cuaucuguuaaguguauu

SEQ ID NO: 905 - RNA, 18 nt, Artificial Sequence
  Description of Artificial Sequence: Synthetic oligonucleotide
augaucuaucuguuaagu

SEQ ID NO: 906 - RNA, 18 nt, Artificial Sequence
  Description of Artificial Sequence: Synthetic oligonucleotide
ggaagaugaucuaucugu

SEQ ID NO: 907 - RNA, 18 nt, Artificial Sequence
  Description of Artificial Sequence: Synthetic oligonucleotide
guuuuggaagaugaucua

SEQ ID NO: 908 - RNA, 18 nt, Artificial Sequence
  Description of Artificial Sequence: Synthetic oligonucleotide
uauguguuuuggaagaug

SEQ ID NO: 909 - RNA, 18 nt, Artificial Sequence
  Description of Artificial Sequence: Synthetic oligonucleotide
aaguguauguguuuugga

SEQ ID NO: 910 - RNA, 18 nt, Artificial Sequence
  Description of Artificial Sequence: Synthetic oligonucleotide
guauuaaguguauguguu

SEQ ID NO: 911 - RNA, 18 nt, Artificial Sequence
  Description of Artificial Sequence: Synthetic oligonucleotide
uagguguauuaaguguau

SEQ ID NO: 912 - RNA, 18 nt, Artificial Sequence
  Description of Artificial Sequence: Synthetic oligonucleotide
ccaauuagguguauuaag

SEQ ID NO: 913 - RNA, 18 nt, Artificial Sequence
  Description of Artificial Sequence: Synthetic oligonucleotide
acaauccaauuaggugua

SEQ ID NO: 914 - RNA, 18 nt, Artificial Sequence
  Description of Artificial Sequence: Synthetic oligonucleotide
uaauuacaauccaauuag

SEQ ID NO: 915 - RNA, 18 nt, Artificial Sequence
  Description of Artificial Sequence: Synthetic oligonucleotide
ccaauuaauuacaaucca

SEQ ID NO: 916 - RNA, 18 nt, Artificial Sequence
  Description of Artificial Sequence: Synthetic oligonucleotide
cccuaccaauuaauuaca

SEQ ID NO: 917 - RNA, 18 nt, Artificial Sequence
  Description of Artificial Sequence: Synthetic oligonucleotide
uuaaucccuaccaauuaa

SEQ ID NO: 918 - RNA, 18 nt, Artificial Sequence
  Description of Artificial Sequence: Synthetic oligonucleotide
agcaguuaaucccuacca

SEQ ID NO: 919 - RNA, 18 nt, Artificial Sequence
  Description of Artificial Sequence: Synthetic oligonucleotide
ucagcagcaguuaauccc

SEQ ID NO: 920 - RNA, 18 nt, Artificial Sequence
  Description of Artificial Sequence: Synthetic oligonucleotide
agaacucagcagcaguua

SEQ ID NO: 921 - RNA, 18 nt, Artificial Sequence
  Description of Artificial Sequence: Synthetic oligonucleotide
auaauagaacucagcagc

SEQ ID NO: 922 - RNA, 18 nt, Artificial Sequence
  Description of Artificial Sequence: Synthetic oligonucleotide
uccaaauaauagaacuca

SEQ ID NO: 923 - RNA, 18 nt, Artificial Sequence
  Description of Artificial Sequence: Synthetic oligonucleotide
uuugauccaaauaauaga

SEQ ID NO: 924 - RNA, 18 nt, Artificial Sequence
  Description of Artificial Sequence: Synthetic oligonucleotide
caaacuuugauccaaaua

SEQ ID NO: 925 - RNA, 18 nt, Artificial Sequence
  Description of Artificial Sequence: Synthetic oligonucleotide
uuccccaaacuuugaucc

SEQ ID NO: 926 - RNA, 18 nt, Artificial Sequence
  Description of Artificial Sequence: Synthetic oligonucleotide
ugucauuccccaaacuuu

SEQ ID NO: 927 - RNA, 18 nt, Artificial Sequence
  Description of Artificial Sequence: Synthetic oligonucleotide
cuaaaugucauuccccaa

SEQ ID NO: 928 - RNA, 18 nt, Artificial Sequence
  Description of Artificial Sequence: Synthetic oligonucleotide
aaaaccuaaaugucauuc

SEQ ID NO: 929 - RNA, 18 nt, Artificial Sequence
  Description of Artificial Sequence: Synthetic oligonucleotide
auucuaaaaccuaaaugu

SEQ ID NO: 930 - RNA, 18 nt, Artificial Sequence
  Description of Artificial Sequence: Synthetic oligonucleotide
uucuaauucuaaaaccua

SEQ ID NO: 931 - RNA, 18 nt, Artificial Sequence
  Description of Artificial Sequence: Synthetic oligonucleotide
ccugguucuaauucuaaa

SEQ ID NO: 932 - RNA, 18 nt, Artificial Sequence
  Description of Artificial Sequence: Synthetic oligonucleotide
cuaugccugguucuaauu

SEQ ID NO: 933 - RNA, 18 nt, Artificial Sequence
  Description of Artificial Sequence: Synthetic oligonucleotide
uauccuuuuaagaauuuu

SEQ ID NO: 934 - RNA, 18 nt, Artificial Sequence
  Description of Artificial Sequence: Synthetic oligonucleotide
gcaacuauccuuuuaaga

SEQ ID NO: 935 - RNA, 18 nt, Artificial Sequence
  Description of Artificial Sequence: Synthetic oligonucleotide
ggguugcaacuauccuuu

SEQ ID NO: 936 - RNA, 18 nt, Artificial Sequence
  Description of Artificial Sequence: Synthetic oligonucleotide
aggcaggguugcaacuau

SEQ ID NO: 937 - RNA, 18 nt, Artificial Sequence
  Description of Artificial Sequence: Synthetic oligonucleotide
cauaaaggcaggguugca

SEQ ID NO: 938 - RNA, 18 nt, Artificial Sequence
  Description of Artificial Sequence: Synthetic oligonucleotide
ggauacauaaaggcaggg

SEQ ID NO: 939 - RNA, 18 nt, Artificial Sequence
  Description of Artificial Sequence: Synthetic oligonucleotide
uaccaggauacauaaagg

SEQ ID NO: 940 - RNA, 18 nt, Artificial Sequence
  Description of Artificial Sequence: Synthetic oligonucleotide
gauaguaccaggauacau

SEQ ID NO: 941 - RNA, 18 nt, Artificial Sequence
  Description of Artificial Sequence: Synthetic oligonucleotide
guaaggauaguaccagga

SEQ ID NO: 942 - RNA, 18 nt, Artificial Sequence
  Description of Artificial Sequence: Synthetic oligonucleotide
acaauguaaggauaguac

SEQ ID NO: 943 - RNA, 18 nt, Artificial Sequence
  Description of Artificial Sequence: Synthetic oligonucleotide
uuguaacaauguaaggau

SEQ ID NO: 944 - RNA, 18 nt, Artificial Sequence
  Description of Artificial Sequence: Synthetic oligonucleotide
cuuuauuguaacaaugua

SEQ ID NO: 945 - RNA, 18 nt, Artificial Sequence
  Description of Artificial Sequence: Synthetic oligonucleotide
uuucucuuuauuguaaca

SEQ ID NO: 946 - RNA, 18 nt, Artificial Sequence
  Description of Artificial Sequence: Synthetic oligonucleotide
uaagauuucucuuuauug

SEQ ID NO: 947 - RNA, 18 nt, Artificial Sequence
  Description of Artificial Sequence: Synthetic oligonucleotide
aaauuuaagauuucucuu

SEQ ID NO: 948 - RNA, 18 nt, Artificial Sequence
  Description of Artificial Sequence: Synthetic oligonucleotide
auugaaaauuuaagauuu

SEQ ID NO: 949 - RNA, 18 nt, Artificial Sequence
  Description of Artificial Sequence: Synthetic oligonucleotide
aagugauugaaaauuuaa

SEQ ID NO: 950 - RNA, 18 nt, Artificial Sequence
  Description of Artificial Sequence: Synthetic oligonucleotide
gaucaaagugauugaaaa

SEQ ID NO: 951 - RNA, 18 nt, Artificial Sequence
  Description of Artificial Sequence: Synthetic oligonucleotide
agggugaucaaagugauu

SEQ ID NO: 952 - RNA, 18 nt, Artificial Sequence
  Description of Artificial Sequence: Synthetic oligonucleotide
ucugcagggugaucaaag

SEQ ID NO: 953 - RNA, 18 nt, Artificial Sequence
  Description of Artificial Sequence: Synthetic oligonucleotide
auuuaucugcagggugau

SEQ ID NO: 954 - RNA, 18 nt, Artificial Sequence
  Description of Artificial Sequence: Synthetic oligonucleotide
cuaaaauuuaucugcagg

SEQ ID NO: 955 - RNA, 18 nt, Artificial Sequence
  Description of Artificial Sequence: Synthetic oligonucleotide
aucugcuaaaauuuaucu

SEQ ID NO: 956 - RNA, 18 nt, Artificial Sequence
  Description of Artificial Sequence: Synthetic oligonucleotide
ggaucaucugcuaaaauu

SEQ ID NO: 957 - RNA, 18 nt, Artificial Sequence
  Description of Artificial Sequence: Synthetic oligonucleotide
ucuaaggaucaucugcua

SEQ ID NO: 958 - RNA, 18 nt, Artificial Sequence
  Description of Artificial Sequence: Synthetic oligonucleotide
uuagaucuaaggaucauc

SEQ ID NO: 959 - RNA, 18 nt, Artificial Sequence
  Description of Artificial Sequence: Synthetic oligonucleotide
acaacuuagaucuaagga

SEQ ID NO: 960 - RNA, 18 nt, Artificial Sequence
  Description of Artificial Sequence: Synthetic oligonucleotide
uaauuacaacuuagaucu

SEQ ID NO: 961 - RNA, 18 nt, Artificial Sequence
  Description of Artificial Sequence: Synthetic oligonucleotide
ccaaauaauuacaacuua

SEQ ID NO: 962 - RNA, 18 nt, Artificial Sequence
  Description of Artificial Sequence: Synthetic oligonucleotide
aucagccaaauaauuaca

SEQ ID NO: 963 - RNA, 18 nt, Artificial Sequence
  Description of Artificial Sequence: Synthetic oligonucleotide
gcucuaucagccaaauaa

SEQ ID NO: 964 - RNA, 18 nt, Artificial Sequence
  Description of Artificial Sequence: Synthetic oligonucleotide
caauagcucuaucagcca

SEQ ID NO: 965 - RNA, 18 nt, Artificial Sequence
  Description of Artificial Sequence: Synthetic oligonucleotide
ugggucaauagcucuauc

SEQ ID NO: 966 - RNA, 18 nt, Artificial Sequence
  Description of Artificial Sequence: Synthetic oligonucleotide
acacaugggucaauagcu

SEQ ID NO: 967 - RNA, 18 nt, Artificial Sequence
  Description of Artificial Sequence: Synthetic oligonucleotide
ugccaacacaugggucaa

SEQ ID NO: 968 - RNA, 18 nt, Artificial Sequence
  Description of Artificial Sequence: Synthetic oligonucleotide
acaaaugccaacacaugg

SEQ ID NO: 969 - RNA, 18 nt, Artificial Sequence
  Description of Artificial Sequence: Synthetic oligonucleotide
gucuuacaaaugccaaca

SEQ ID NO: 970 - RNA, 18 nt, Artificial Sequence
  Description of Artificial Sequence: Synthetic oligonucleotide
agaaagucuuacaaaugc

SEQ ID NO: 971 - RNA, 18 nt, Artificial Sequence
  Description of Artificial Sequence: Synthetic oligonucleotide
uuuuuagaaagucuuaca

SEQ ID NO: 972 - RNA, 18 nt, Artificial Sequence
  Description of Artificial Sequence: Synthetic oligonucleotide
agcacuuuuuagaaaguc

SEQ ID NO: 973 - RNA, 18 nt, Artificial Sequence
  Description of Artificial Sequence: Synthetic oligonucleotide
gcuggagcacuuuuuaga

SEQ ID NO: 974 - RNA, 18 nt, Artificial Sequence
  Description of Artificial Sequence: Synthetic oligonucleotide
aauuugcuggagcacuuu

SEQ ID NO: 975 - RNA, 18 nt, Artificial Sequence
  Description of Artificial Sequence: Synthetic oligonucleotide
auuaaaauuugcuggagc

SEQ ID NO: 976 - RNA, 18 nt, Artificial Sequence
  Description of Artificial Sequence: Synthetic oligonucleotide
gcaguauuaaaauuugcu

SEQ ID NO: 977 - RNA, 18 nt, Artificial Sequence
  Description of Artificial Sequence: Synthetic oligonucleotide
uuaaagcaguauuaaaau

SEQ ID NO: 978 - RNA, 18 nt, Artificial Sequence
  Description of Artificial Sequence: Synthetic oligonucleotide
gauauuuaaagcaguauu

SEQ ID NO: 979 - RNA, 18 nt, Artificial Sequence
  Description of Artificial Sequence: Synthetic oligonucleotide
gucaugauauuuaaagca

SEQ ID NO: 980 - RNA, 18 nt, Artificial Sequence
  Description of Artificial Sequence: Synthetic oligonucleotide
auggugucaugauauuua

SEQ ID NO: 981 - RNA, 18 nt, Artificial Sequence
  Description of Artificial Sequence: Synthetic oligonucleotide
aguucauggugucaugau

SEQ ID NO: 982 - RNA, 18 nt, Artificial Sequence
  Description of Artificial Sequence: Synthetic oligonucleotide
uuuagaguucaugguguc

SEQ ID NO: 983 - RNA, 18 nt, Artificial Sequence
  Description of Artificial Sequence: Synthetic oligonucleotide
aauucuuuagaguucaug

SEQ ID NO: 984 - RNA, 18 nt, Artificial Sequence
  Description of Artificial Sequence: Synthetic oligonucleotide
uuuucaauucuuuagagu

SEQ ID NO: 985 - RNA, 18 nt, Artificial Sequence
  Description of Artificial Sequence: Synthetic oligonucleotide
agcacuuuucaauucuuu

SEQ ID NO: 986 - RNA, 18 nt, Artificial Sequence
  Description of Artificial Sequence: Synthetic oligonucleotide
ucacaagcacuuuucaau

SEQ ID NO: 987 - RNA, 18 nt, Artificial Sequence
  Description of Artificial Sequence: Synthetic oligonucleotide
ccaacucacaagcacuuu

SEQ ID NO: 988 - RNA, 18 nt, Artificial Sequence
  Description of Artificial Sequence: Synthetic oligonucleotide
gauaaccaacucacaagc

SEQ ID NO: 989 - RNA, 18 nt, Artificial Sequence
  Description of Artificial Sequence: Synthetic oligonucleotide
cccuugauaaccaacuca

SEQ ID NO: 990 - RNA, 18 nt, Artificial Sequence
  Description of Artificial Sequence: Synthetic oligonucleotide
uccuccccuugauaacca

SEQ ID NO: 991 - RNA, 18 nt, Artificial Sequence
  Description of Artificial Sequence: Synthetic oligonucleotide
auauauccuccccuugau

SEQ ID NO: 992 - RNA, 18 nt, Artificial Sequence
  Description of Artificial Sequence: Synthetic oligonucleotide
auuugauauauccucccc

SEQ ID NO: 993 - RNA, 18 nt, Artificial Sequence
  Description of Artificial Sequence: Synthetic oligonucleotide
uggccauuugauauaucc

SEQ ID NO: 994 - RNA, 18 nt, Artificial Sequence
  Description of Artificial Sequence: Synthetic oligonucleotide
caaaauggccauuugaua

SEQ ID NO: 995 - RNA, 18 nt, Artificial Sequence
  Description of Artificial Sequence: Synthetic oligonucleotide
uugaacaaaauggccauu

SEQ ID NO: 996 - RNA, 18 nt, Artificial Sequence
  Description of Artificial Sequence: Synthetic oligonucleotide
acauauugaacaaaaugg

SEQ ID NO: 997 - RNA, 18 nt, Artificial Sequence
  Description of Artificial Sequence: Synthetic oligonucleotide
agaacacauauugaacaa

SEQ ID NO: 998 - RNA, 18 nt, Artificial Sequence
  Description of Artificial Sequence: Synthetic oligonucleotide
uuucuagaacacauauug

SEQ ID NO: 999 - RNA, 18 nt, Artificial Sequence
  Description of Artificial Sequence: Synthetic oligonucleotide
uuucauuucuagaacaca

SEQ ID NO: 1000 - RNA, 18 nt, Artificial Sequence
  Description of Artificial Sequence: Synthetic oligonucleotide
uggcuuuucauuucuaga

SEQ ID NO: 1001 - RNA, 18 nt, Artificial Sequence
  Description of Artificial Sequence: Synthetic oligonucleotide
uaguauggcuuuucauuu

SEQ ID NO: 1002 - RNA, 18 nt, Artificial Sequence
  Description of Artificial Sequence: Synthetic oligonucleotide
uauuuuaguauggcuuuu

SEQ ID NO: 1003 - RNA, 18 nt, Artificial Sequence
  Description of Artificial Sequence: Synthetic oligonucleotide
gacaguauuuuaguaugg

SEQ ID NO: 1004 - RNA, 18 nt, Artificial Sequence
  Description of Artificial Sequence: Synthetic oligonucleotide
accaagacaguauuuuag

SEQ ID NO: 1005 - RNA, 18 nt, Artificial Sequence
  Description of Artificial Sequence: Synthetic oligonucleotide
uuuggaccaagacaguau

SEQ ID NO: 1006 - RNA, 18 nt, Artificial Sequence
  Description of Artificial Sequence: Synthetic oligonucleotide
cagauuuuggaccaagac

SEQ ID NO: 1007 - RNA, 18 nt, Artificial Sequence
  Description of Artificial Sequence: Synthetic oligonucleotide
uuacacagauuuuggacc

SEQ ID NO: 1008 - RNA, 18 nt, Artificial Sequence
  Description of Artificial Sequence: Synthetic oligonucleotide
aaauuuuacacagauuuu

SEQ ID NO: 1009 - RNA, 18 nt, Artificial Sequence
  Description of Artificial Sequence: Synthetic oligonucleotide
aaaacaaauuuuacacag

SEQ ID NO: 1010 - RNA, 18 nt, Artificial Sequence
  Description of Artificial Sequence: Synthetic oligonucleotide
auuucaaaacaaauuuua

SEQ ID NO: 1011 - RNA, 18 nt, Artificial Sequence
  Description of Artificial Sequence: Synthetic oligonucleotide
aagacauuucaaaacaaa

SEQ ID NO: 1012 - RNA, 18 nt, Artificial Sequence
  Description of Artificial Sequence: Synthetic oligonucleotide
uuugaaagacauuucaaa

SEQ ID NO: 1013 - RNA, 18 nt, Artificial Sequence
  Description of Artificial Sequence: Synthetic oligonucleotide
auauuuuugaaagacauu

SEQ ID NO: 1014 - RNA, 18 nt, Artificial Sequence
  Description of Artificial Sequence: Synthetic oligonucleotide
agggaauauuuuugaaag

SEQ ID NO: 1015 - RNA, 18 nt, Artificial Sequence
  Description of Artificial Sequence: Synthetic oligonucleotide
ucaaaagggaauauuuuu

SEQ ID NO: 1016 - RNA, 18 nt, Artificial Sequence
  Description of Artificial Sequence: Synthetic oligonucleotide
aauuuucaaaagggaaua

SEQ ID NO: 1017 - RNA, 18 nt, Artificial Sequence
  Description of Artificial Sequence: Synthetic oligonucleotide
gauauaauuuucaaaagg

SEQ ID NO: 1018 - RNA, 18 nt, Artificial Sequence
  Description of Artificial Sequence: Synthetic oligonucleotide
uuacugauauaauuuuca

SEQ ID NO: 1019 - RNA, 18 nt, Artificial Sequence
  Description of Artificial Sequence: Synthetic oligonucleotide
uauucuuacugauauaau

SEQ ID NO: 1020 - RNA, 18 nt, Artificial Sequence
  Description of Artificial Sequence: Synthetic oligonucleotide
auaaauauucuuacugau

SEQ ID NO: 1021 - RNA, 18 nt, Artificial Sequence
  Description of Artificial Sequence: Synthetic oligonucleotide
guuuaauaaauauucuua

SEQ ID NO: 1022 - RNA, 18 nt, Artificial Sequence
  Description of Artificial Sequence: Synthetic oligonucleotide
cugauguuuaauaaauau

SEQ ID NO: 1023 - RNA, 18 nt, Artificial Sequence
  Description of Artificial Sequence: Synthetic oligonucleotide
uagaccugauguuuaaua

SEQ ID NO: 1024 - RNA, 18 nt, Artificial Sequence
  Description of Artificial Sequence: Synthetic oligonucleotide
uaauuuagaccugauguu

SEQ ID NO: 1025 - RNA, 18 nt, Artificial Sequence
  Description of Artificial Sequence: Synthetic oligonucleotide
aaaaauaauuuagaccug

SEQ ID NO: 1026 - RNA, 18 nt, Artificial Sequence
  Description of Artificial Sequence: Synthetic oligonucleotide
ggaguaaaaauaauuuag

SEQ ID NO: 1027 - RNA, 18 nt, Artificial Sequence
  Description of Artificial Sequence: Synthetic oligonucleotide
acuuuggaguaaaaauaa

SEQ ID NO: 1028 - RNA, 18 nt, Artificial Sequence
  Description of Artificial Sequence: Synthetic oligonucleotide
guuuuacuuuggaguaaa

SEQ ID NO: 1029 - RNA, 18 nt, Artificial Sequence
  Description of Artificial Sequence: Synthetic oligonucleotide
ugcauguuuuacuuugga

SEQ ID NO: 1030 - RNA, 18 nt, Artificial Sequence
  Description of Artificial Sequence: Synthetic oligonucleotide
uccauccuuugaaugugg

SEQ ID NO: 1031 - RNA, 18 nt, Artificial Sequence
  Description of Artificial Sequence: Synthetic oligonucleotide
auccauccauccuuugaa

SEQ ID NO: 1032 - RNA, 18 nt, Artificial Sequence
  Description of Artificial Sequence: Synthetic oligonucleotide
auuauauccauccauccu

SEQ ID NO: 1033 - RNA, 18 nt, Artificial Sequence
  Description of Artificial Sequence: Synthetic oligonucleotide
cauacauuauauccaucc

SEQ ID NO: 1034 - RNA, 18 nt, Artificial Sequence
  Description of Artificial Sequence: Synthetic oligonucleotide
ugcugcauacauuauauc

SEQ ID NO: 1035 - RNA, 18 nt, Artificial Sequence
  Description of Artificial Sequence: Synthetic oligonucleotide
ucaacugcugcauacauu

SEQ ID NO: 1036 - RNA, 18 nt, Artificial Sequence
  Description of Artificial Sequence: Synthetic oligonucleotide
uggaaucaacugcugcau

SEQ ID NO: 1037 - RNA, 18 nt, Artificial Sequence
  Description of Artificial Sequence: Synthetic oligonucleotide
auuucuggaaucaacugc

SEQ ID NO: 1038 - RNA, 18 nt, Artificial Sequence
  Description of Artificial Sequence: Synthetic oligonucleotide
cuccuccaccagcaucag

SEQ ID NO: 1039 - RNA, 18 nt, Artificial Sequence
  Description of Artificial Sequence: Synthetic oligonucleotide
agcuccuccuccaccagc

SEQ ID NO: 1040 - RNA, 18 nt, Artificial Sequence
  Description of Artificial Sequence: Synthetic oligonucleotide
ggcgcagcuccuccucca

SEQ ID NO: 1041 - RNA, 18 nt, Artificial Sequence
  Description of Artificial Sequence: Synthetic oligonucleotide
gucccggcgcagcuccuc

SEQ ID NO: 1042 - RNA, 18 nt, Artificial Sequence
  Description of Artificial Sequence: Synthetic oligonucleotide
ggguggucccggcgcagc

SEQ ID NO: 1043 - RNA, 18 nt, Artificial Sequence
  Description of Artificial Sequence: Synthetic oligonucleotide
cggcucagccauggcggg

SEQ ID NO: 1044 - RNA, 18 nt, Artificial Sequence
  Description of Artificial Sequence: Synthetic oligonucleotide
cagcggcucagccauggc

SEQ ID NO: 1045 - RNA, 18 nt, Artificial Sequence
  Description of Artificial Sequence: Synthetic oligonucleotide
ucuggcagcggcucagcc

SEQ ID NO: 1046 - RNA, 18 nt, Artificial Sequence
  Description of Artificial Sequence: Synthetic oligonucleotide
uggguucuggcagcggcu

SEQ ID NO: 1047 - RNA, 18 nt, Artificial Sequence
  Description of Artificial Sequence: Synthetic oligonucleotide
cuucuuggguucuggcag

SEQ ID NO: 1048 - RNA, 18 nt, Artificial Sequence
  Description of Artificial Sequence: Synthetic oligonucleotide
agccucuucuuggguucu

SEQ ID NO: 1049 - RNA, 18 nt, Artificial Sequence
  Description of Artificial Sequence: Synthetic oligonucleotide
cgagcagccucuucuugg

SEQ ID NO: 1050 - RNA, 18 nt, Artificial Sequence
  Description of Artificial Sequence: Synthetic oligonucleotide
agcgucgagcagccucuu

SEQ ID NO: 1051 - RNA, 18 nt, Artificial Sequence
  Description of Artificial Sequence: Synthetic oligonucleotide
auaaaugacauuguaauu

SEQ ID NO: 1052 - RNA, 18 nt, Artificial Sequence
  Description of Artificial Sequence: Synthetic oligonucleotide
agaagauaaaugacauug

SEQ ID NO: 1053 - RNA, 18 nt, Artificial Sequence
  Description of Artificial Sequence: Synthetic oligonucleotide
cacggagaagauaaauga

SEQ ID NO: 1054 - RNA, 18 nt, Artificial Sequence
  Description of Artificial Sequence: Synthetic oligonucleotide
ugggacacggagaagaua

SEQ ID NO: 1055 - RNA, 18 nt, Artificial Sequence
  Description of Artificial Sequence: Synthetic oligonucleotide
gggaugggacacggagaa

SEQ ID NO: 1056 - RNA, 18 nt, Artificial Sequence
  Description of Artificial Sequence: Synthetic oligonucleotide
gacagugggauggauggg

SEQ ID NO: 1057 - RNA, 18 nt, Artificial Sequence
  Description of Artificial Sequence: Synthetic oligonucleotide
cgaaagacagugggaugg

SEQ ID NO: 1058 - RNA, 18 nt, Artificial Sequence
  Description of Artificial Sequence: Synthetic oligonucleotide
gugcacgaaagacagugg

SEQ ID NO: 1059 - RNA, 18 nt, Artificial Sequence
  Description of Artificial Sequence: Synthetic oligonucleotide
agugagugcacgaaagac

SEQ ID NO: 1060 - RNA, 18 nt, Artificial Sequence
  Description of Artificial Sequence: Synthetic oligonucleotide
gguguagugagugcacga

SEQ ID NO: 1061 - RNA, 18 nt, Artificial Sequence
  Description of Artificial Sequence: Synthetic oligonucleotide
uggcugguguagugagug

SEQ ID NO: 1062 - RNA, 18 nt, Artificial Sequence
  Description of Artificial Sequence: Synthetic oligonucleotide
cuagguggcugguguagu

SEQ ID NO: 1063 - RNA, 18 nt, Artificial Sequence
  Description of Artificial Sequence: Synthetic oligonucleotide
gggcuagguggcuggugu

SEQ ID NO: 1064 - RNA, 18 nt, Artificial Sequence
  Description of Artificial Sequence: Synthetic oligonucleotide
gagacagauggugauggg

SEQ ID NO: 1065 - RNA, 18 nt, Artificial Sequence
  Description of Artificial Sequence: Synthetic oligonucleotide
uaugagagacagauggug

SEQ ID NO: 1066 - RNA, 18 nt, Artificial Sequence
  Description of Artificial Sequence: Synthetic oligonucleotide
cagacuaugagagacaga

SEQ ID NO: 1067 - RNA, 18 nt, Artificial Sequence
  Description of Artificial Sequence: Synthetic oligonucleotide
aacagcagacuaugagag

SEQ ID NO: 1068 - RNA, 18 nt, Artificial Sequence
  Description of Artificial Sequence: Synthetic oligonucleotide
ggacaaacagcagacuau

SEQ ID NO: 1069 - RNA, 18 nt, Artificial Sequence
  Description of Artificial Sequence: Synthetic oligonucleotide
ccaguggacaaacagcag

SEQ ID NO: 1070 - RNA, 18 nt, Artificial Sequence
  Description of Artificial Sequence: Synthetic oligonucleotide
agcagccaguggacaaac

SEQ ID NO: 1071 - RNA, 18 nt, Artificial Sequence
  Description of Artificial Sequence: Synthetic oligonucleotide
ccaggagcagccagugga

SEQ ID NO: 1072 - RNA, 18 nt, Artificial Sequence
  Description of Artificial Sequence: Synthetic oligonucleotide
ggcugccaggagcagcca

SEQ ID NO: 1073 - RNA, 18 nt, Artificial Sequence
  Description of Artificial Sequence: Synthetic oligonucleotide
gggcugccaggagcagcc

SEQ ID NO: 1074 - RNA, 18 nt, Artificial Sequence
  Description of Artificial Sequence: Synthetic oligonucleotide
cgaugggaugaagauggg

SEQ ID NO: 1075 - RNA, 18 nt, Artificial Sequence
  Description of Artificial Sequence: Synthetic oligonucleotide
acagacgaugggaugaag

SEQ ID NO: 1076 - RNA, 18 nt, Artificial Sequence
  Description of Artificial Sequence: Synthetic oligonucleotide
aaggcacagacgauggga

SEQ ID NO: 1077 - RNA, 18 nt, Artificial Sequence
  Description of Artificial Sequence: Synthetic oligonucleotide
ugacaaaggcacagacga

SEQ ID NO: 1078 - RNA, 18 nt, Artificial Sequence
  Description of Artificial Sequence: Synthetic oligonucleotide
aggagugacaaaggcaca

SEQ ID NO: 1079 - RNA, 18 nt, Artificial Sequence
  Description of Artificial Sequence: Synthetic oligonucleotide
cugccaggagugacaaag

SEQ ID NO: 1080 - RNA, 18 nt, Artificial Sequence
  Description of Artificial Sequence: Synthetic oligonucleotide
ugacgcugccaggaguga

SEQ ID NO: 1081 - RNA, 18 nt, Artificial Sequence
  Description of Artificial Sequence: Synthetic oligonucleotide
ugggcugacgcugccagg

SEQ ID NO: 1082 - RNA, 18 nt, Artificial Sequence
  Description of Artificial Sequence: Synthetic oligonucleotide
ggaguugggcugacgcug

SEQ ID NO: 1083 - RNA, 18 nt, Artificial Sequence
  Description of Artificial Sequence: Synthetic oligonucleotide
gcacaggaguugggcuga

SEQ ID NO: 1084 - RNA, 18 nt, Artificial Sequence
  Description of Artificial Sequence: Synthetic oligonucleotide
ggaaggcacaggaguugg

SEQ ID NO: 1085 - RNA, 18 nt, Artificial Sequence
  Description of Artificial Sequence: Synthetic oligonucleotide
ggaugggaaggcacagga

SEQ ID NO: 1086 - RNA, 18 nt, Artificial Sequence
  Description of Artificial Sequence: Synthetic oligonucleotide
agacuggaugggaaggca

SEQ ID NO: 1087 - RNA, 18 nt, Artificial Sequence
  Description of Artificial Sequence: Synthetic oligonucleotide
ugggaagacuggauggga

SEQ ID NO: 1088 - RNA, 18 nt, Artificial Sequence
  Description of Artificial Sequence: Synthetic oligonucleotide
aggagugggaagacugga

SEQ ID NO: 1089 - RNA, 18 nt, Artificial Sequence
  Description of Artificial Sequence: Synthetic oligonucleotide
cagagaggagugggaaga

SEQ ID NO: 1090 - RNA, 18 nt, Artificial Sequence
  Description of Artificial Sequence: Synthetic oligonucleotide
agaugcagagaggagugg

SEQ ID NO: 1091 - RNA, 18 nt, Artificial Sequence
  Description of Artificial Sequence: Synthetic oligonucleotide
uccugagaugcagagagg

SEQ ID NO: 1092 - RNA, 18 nt, Artificial Sequence
  Description of Artificial Sequence: Synthetic oligonucleotide
gaagguccugagaugcag

SEQ ID NO: 1093 - RNA, 18 nt, Artificial Sequence
  Description of Artificial Sequence: Synthetic oligonucleotide
guagagaagguccugaga

SEQ ID NO: 1094 - RNA, 18 nt, Artificial Sequence
  Description of Artificial Sequence: Synthetic oligonucleotide
uucugguagagaaggucc

SEQ ID NO: 1095 - RNA, 18 nt, Artificial Sequence
  Description of Artificial Sequence: Synthetic oligonucleotide
caagguucugguagagaa

SEQ ID NO: 1096 - RNA, 18 nt, Artificial Sequence
  Description of Artificial Sequence: Synthetic oligonucleotide
aagaccaagguucuggua

SEQ ID NO: 1097 - RNA, 18 nt, Artificial Sequence
  Description of Artificial Sequence: Synthetic oligonucleotide
gcagaaagaccaagguuc

SEQ ID NO: 1098 - RNA, 18 nt, Artificial Sequence
  Description of Artificial Sequence: Synthetic oligonucleotide
gggcagaaagaccaaggu

SEQ ID NO: 1099 - RNA, 18 nt, Artificial Sequence
  Description of Artificial Sequence: Synthetic oligonucleotide
uucuuggaacuagguggg

SEQ ID NO: 1100 - RNA, 18 nt, Artificial Sequence
  Description of Artificial Sequence: Synthetic oligonucleotide
ggguucuuggaacuaggu

SEQ ID NO: 1101 - RNA, 18 nt, Artificial Sequence
  Description of Artificial Sequence: Synthetic oligonucleotide
ggagugagcaaagaaggg

SEQ ID NO: 1102 - RNA, 18 nt, Artificial Sequence
  Description of Artificial Sequence: Synthetic oligonucleotide
gaauaggagugagcaaag

SEQ ID NO: 1103 - RNA, 18 nt, Artificial Sequence
  Description of Artificial Sequence: Synthetic oligonucleotide
ggcuugaauaggagugag

SEQ ID NO: 1104 - RNA, 18 nt, Artificial Sequence
  Description of Artificial Sequence: Synthetic oligonucleotide
aacguggcuugaauagga

SEQ ID NO: 1105 - RNA, 18 nt, Artificial Sequence
  Description of Artificial Sequence: Synthetic oligonucleotide
ugaacaacguggcuugaa

SEQ ID NO: 1106 - RNA, 18 nt, Artificial Sequence
  Description of Artificial Sequence: Synthetic oligonucleotide
gaagcugaacaacguggc

SEQ ID NO: 1107 - RNA, 18 nt, Artificial Sequence
  Description of Artificial Sequence: Synthetic oligonucleotide
cagaggaagcugaacaac

SEQ ID NO: 1108 - RNA, 18 nt, Artificial Sequence
  Description of Artificial Sequence: Synthetic oligonucleotide
gagcgcagaggaagcuga

SEQ ID NO: 1109 - RNA, 18 nt, Artificial Sequence
  Description of Artificial Sequence: Synthetic oligonucleotide
cccaagagcgcagaggaa

SEQ ID NO: 1110 - RNA, 18 nt, Artificial Sequence
  Description of Artificial Sequence: Synthetic oligonucleotide
ucuggcccaagagcgcag

SEQ ID NO: 1111 - RNA, 18 nt, Artificial Sequence
  Description of Artificial Sequence: Synthetic oligonucleotide
agcccucuggcccaagag

SEQ ID NO: 1112 - RNA, 18 nt, Artificial Sequence
  Description of Artificial Sequence: Synthetic oligonucleotide
cuucuagcccucuggccc

SEQ ID NO: 1113 - RNA, 18 nt, Artificial Sequence
  Description of Artificial Sequence: Synthetic oligonucleotide
ggcagcuucuagcccucu

SEQ ID NO: 1114 - RNA, 18 nt, Artificial Sequence
  Description of Artificial Sequence: Synthetic oligonucleotide
aaaacggcagcuucuagc

SEQ ID NO: 1115 - RNA, 18 nt, Artificial Sequence
  Description of Artificial Sequence: Synthetic oligonucleotide
uccagaaaacggcagcuu

SEQ ID NO: 1116 - RNA, 18 nt, Artificial Sequence
  Description of Artificial Sequence: Synthetic oligonucleotide
ucuauuccagaaaacggc

SEQ ID NO: 1117 - RNA, 18 nt, Artificial Sequence
  Description of Artificial Sequence: Synthetic oligonucleotide
ugugcucuauuccagaaa

SEQ ID NO: 1118 - RNA, 18 nt, Artificial Sequence
  Description of Artificial Sequence: Synthetic oligonucleotide
ugcccugugcucuauucc

SEQ ID NO: 1119 - RNA, 18 nt, Artificial Sequence
  Description of Artificial Sequence: Synthetic oligonucleotide
cauacugcccugugcucu

SEQ ID NO: 1120 - RNA, 18 nt, Artificial Sequence
  Description of Artificial Sequence: Synthetic oligonucleotide
cagaucauacugcccugu

SEQ ID NO: 1121 - RNA, 18 nt, Artificial Sequence
  Description of Artificial Sequence: Synthetic oligonucleotide
aacuacagaucauacugc

SEQ ID NO: 1122 - RNA, 18 nt, Artificial Sequence
  Description of Artificial Sequence: Synthetic oligonucleotide
ggagaaacuacagaucau

SEQ ID NO: 1123 - RNA, 18 nt, Artificial Sequence
  Description of Artificial Sequence: Synthetic oligonucleotide
ggccuggagaaacuacag

SEQ ID NO: 1124 - RNA, 18 nt, Artificial Sequence
  Description of Artificial Sequence: Synthetic oligonucleotide
gccagggccuggagaaac

SEQ ID NO: 1125 - RNA, 18 nt, Artificial Sequence
  Description of Artificial Sequence: Synthetic oligonucleotide
uaccggccagggccugga

SEQ ID NO: 1126 - RNA, 18 nt, Artificial Sequence
  Description of Artificial Sequence: Synthetic oligonucleotide
caggguaccggccagggc

SEQ ID NO: 1127 - RNA, 18 nt, Artificial Sequence
  Description of Artificial Sequence: Synthetic oligonucleotide
guuuucaggguaccggcc

SEQ ID NO: 1128 - RNA, 18 nt, Artificial Sequence
  Description of Artificial Sequence: Synthetic oligonucleotide
cccaaguuuucaggguac

SEQ ID NO: 1129 - RNA, 18 nt, Artificial Sequence
  Description of Artificial Sequence: Synthetic oligonucleotide
ggguccccaaguuuucag

SEQ ID NO: 1130 - RNA, 18 nt, Artificial Sequence
  Description of Artificial Sequence: Synthetic oligonucleotide
gugauggguccccaaguu

SEQ ID NO: 1131 - RNA, 18 nt, Artificial Sequence
  Description of Artificial Sequence: Synthetic oligonucleotide
cagaggugaugggucccc

SEQ ID NO: 1132 - RNA, 18 nt, Artificial Sequence
  Description of Artificial Sequence: Synthetic oligonucleotide
gagaacagaggugauggg

SEQ ID NO: 1133 - RNA, 18 nt, Artificial Sequence
  Description of Artificial Sequence: Synthetic oligonucleotide
gccaagagaacagaggug

SEQ ID NO: 1134 - RNA, 18 nt, Artificial Sequence
  Description of Artificial Sequence: Synthetic oligonucleotide
agggagccaagagaacag

SEQ ID NO: 1135 - RNA, 18 nt, Artificial Sequence
  Description of Artificial Sequence: Synthetic oligonucleotide
aaauuagggagccaagag

SEQ ID NO: 1136 - RNA, 18 nt, Artificial Sequence
  Description of Artificial Sequence: Synthetic oligonucleotide
caggaaaauuagggagcc

SEQ ID NO: 1137 - RNA, 18 nt, Artificial Sequence
  Description of Artificial Sequence: Synthetic oligonucleotide
aaaacugagcuugcauuu

SEQ ID NO: 1138 - RNA, 18 nt, Artificial Sequence
  Description of Artificial Sequence: Synthetic oligonucleotide
gaagaaaaacugagcuug

SEQ ID NO: 1139 - RNA, 18 nt, Artificial Sequence
  Description of Artificial Sequence: Synthetic oligonucleotide
aaucugaagaaaaacuga

SEQ ID NO: 1140 - RNA, 18 nt, Artificial Sequence
  Description of Artificial Sequence: Synthetic oligonucleotide
uucauaaucugaagaaaa

SEQ ID NO: 1141 - RNA, 18 nt, Artificial Sequence
  Description of Artificial Sequence: Synthetic oligonucleotide
auuucuucauaaucugaa

SEQ ID NO: 1142 - RNA, 18 nt, Artificial Sequence
  Description of Artificial Sequence: Synthetic oligonucleotide
uuggaauuucuucauaau

SEQ ID NO: 1143 - RNA, 18 nt, Artificial Sequence
  Description of Artificial Sequence: Synthetic oligonucleotide
uggauuuggaauuucuuc

SEQ ID NO: 1144 - RNA, 18 nt, Artificial Sequence
  Description of Artificial Sequence: Synthetic oligonucleotide
cccuguggauuuggaauu

SEQ ID NO: 1145 - RNA, 18 nt, Artificial Sequence
  Description of Artificial Sequence: Synthetic oligonucleotide
caaaccccuguggauuug

SEQ ID NO: 1146 - RNA, 18 nt, Artificial Sequence
  Description of Artificial Sequence: Synthetic oligonucleotide
uaauccaaaccccugugg

SEQ ID NO: 1147 - RNA, 18 nt, Artificial Sequence
  Description of Artificial Sequence: Synthetic oligonucleotide
cucauuaauccaaacccc

SEQ ID NO: 1148 - RNA, 18 nt, Artificial Sequence
  Description of Artificial Sequence: Synthetic oligonucleotide
aaaaccucauuaauccaa

SEQ ID NO: 1149 - RNA, 18 nt, Artificial Sequence
  Description of Artificial Sequence: Synthetic oligonucleotide
acagcaaaaccucauuaa

SEQ ID NO: 1150 - RNA, 18 nt, Artificial Sequence
  Description of Artificial Sequence: Synthetic oligonucleotide
gcaguacagcaaaaccuc

SEQ ID NO: 1151 - RNA, 18 nt, Artificial Sequence
  Description of Artificial Sequence: Synthetic oligonucleotide
gggaggcaguacagcaaa

SEQ ID NO: 1152 - RNA, 18 nt, Artificial Sequence
  Description of Artificial Sequence: Synthetic oligonucleotide
cauguugaggaauaaggg

SEQ ID NO: 1153 - RNA, 18 nt, Artificial Sequence
  Description of Artificial Sequence: Synthetic oligonucleotide
uucauguugaggaauaag

SEQ ID NO: 1154 - RNA, 18 nt, Artificial Sequence
  Description of Artificial Sequence: Synthetic oligonucleotide
ggaacuucauguugagga

SEQ ID NO: 1155 - RNA, 18 nt, Artificial Sequence
  Description of Artificial Sequence: Synthetic oligonucleotide
aggugggaacuucauguu

SEQ ID NO: 1156 - RNA, 18 nt, Artificial Sequence
  Description of Artificial Sequence: Synthetic oligonucleotide
auccgaggugggaacuuc

SEQ ID NO: 1157 - RNA, 18 nt, Artificial Sequence
  Description of Artificial Sequence: Synthetic oligonucleotide
ccccaauccgagguggga

SEQ ID NO: 1158 - RNA, 18 nt, Artificial Sequence
  Description of Artificial Sequence: Synthetic oligonucleotide
cccauccccaauccgagg

SEQ ID NO: 1159 - RNA, 18 nt, Artificial Sequence
  Description of Artificial Sequence: Synthetic oligonucleotide
ucccacccauccccaauc

SEQ ID NO: 1160 - RNA, 18 nt, Artificial Sequence
  Description of Artificial Sequence: Synthetic oligonucleotide
cccccucccacccauccc

SEQ ID NO: 1161 - RNA, 18 nt, Artificial Sequence
  Description of Artificial Sequence: Synthetic oligonucleotide
ugaaacccccucccaccc

SEQ ID NO: 1162 - RNA, 18 nt, Artificial Sequence
  Description of Artificial Sequence: Synthetic oligonucleotide
ccucuugaaacccccucc

SEQ ID NO: 1163 - RNA, 18 nt, Artificial Sequence
  Description of Artificial Sequence: Synthetic oligonucleotide
cuccuccucuugaaaccc

SEQ ID NO: 1164 - RNA, 18 nt, Artificial Sequence
  Description of Artificial Sequence: Synthetic oligonucleotide
ccacccuccuccucuuga

SEQ ID NO: 1165 - RNA, 18 nt, Artificial Sequence
  Description of Artificial Sequence: Synthetic oligonucleotide
ccaucccacccuccuccu

SEQ ID NO: 1166 - RNA, 18 nt, Artificial Sequence
  Description of Artificial Sequence: Synthetic oligonucleotide
cuugcccaucccacccuc

SEQ ID NO: 1167 - RNA, 18 nt, Artificial Sequence
  Description of Artificial Sequence: Synthetic oligonucleotide
uauuccuugcccauccca

SEQ ID NO: 1168 - RNA, 18 nt, Artificial Sequence
  Description of Artificial Sequence: Synthetic oligonucleotide
guguauauuccuugccca

SEQ ID NO: 1169 - RNA, 18 nt, Artificial Sequence
  Description of Artificial Sequence: Synthetic oligonucleotide
caccuguguauauuccuu

SEQ ID NO: 1170 - RNA, 18 nt, Artificial Sequence
  Description of Artificial Sequence: Synthetic oligonucleotide
ggcuucaccuguguauau

SEQ ID NO: 1171 - RNA, 18 nt, Artificial Sequence
  Description of Artificial Sequence: Synthetic oligonucleotide
ucucuggcuucaccugug

SEQ ID NO: 1172 - RNA, 18 nt, Artificial Sequence
  Description of Artificial Sequence: Synthetic oligonucleotide
acccuucucuggcuucac

SEQ ID NO: 1173 - RNA, 18 nt, Artificial Sequence
  Description of Artificial Sequence: Synthetic oligonucleotide
accuaacccuucucuggc

SEQ ID NO: 1174 - RNA, 18 nt, Artificial Sequence
  Description of Artificial Sequence: Synthetic oligonucleotide
ccccaaccuaacccuucu

SEQ ID NO: 1175 - RNA, 18 nt, Artificial Sequence
  Description of Artificial Sequence: Synthetic oligonucleotide
cgcacccccaaccuaacc

SEQ ID NO: 1176 - RNA, 18 nt, Artificial Sequence
  Description of Artificial Sequence: Synthetic oligonucleotide
cccaccgcacccccaacc

SEQ ID NO: 1177 - RNA, 18 nt, Artificial Sequence
  Description of Artificial Sequence: Synthetic oligonucleotide
aaguucccaccgcacccc

SEQ ID NO: 1178 - RNA, 18 nt, Artificial Sequence
  Description of Artificial Sequence: Synthetic oligonucleotide
acagcaaguucccaccgc

SEQ ID NO: 1179 - RNA, 18 nt, Artificial Sequence
  Description of Artificial Sequence: Synthetic oligonucleotide
ucaaaacagcaaguuccc

SEQ ID NO: 1180 - RNA, 18 nt, Artificial Sequence
  Description of Artificial Sequence: Synthetic oligonucleotide
ccagaucaaaacagcaag

SEQ ID NO: 1181 - RNA, 18 nt, Artificial Sequence
  Description of Artificial Sequence: Synthetic oligonucleotide
ggaaaccagaucaaaaca

SEQ ID NO: 1182 - RNA, 18 nt, Artificial Sequence
  Description of Artificial Sequence: Synthetic oligonucleotide
caccaggaaaccagauca

SEQ ID NO: 1183 - RNA, 18 nt, Artificial Sequence
  Description of Artificial Sequence: Synthetic oligonucleotide
ugucacaccaggaaacca

SEQ ID NO: 1184 - RNA, 18 nt, Artificial Sequence
  Description of Artificial Sequence: Synthetic oligonucleotide
cagagugucacaccagga

SEQ ID NO: 1185 - RNA, 18 nt, Artificial Sequence
  Description of Artificial Sequence: Synthetic oligonucleotide
uaacccagagugucacac

SEQ ID NO: 1186 - RNA, 18 nt, Artificial Sequence
  Description of Artificial Sequence: Synthetic oligonucleotide
gccuuuaacccagagugu

SEQ ID NO: 1187 - RNA, 18 nt, Artificial Sequence
  Description of Artificial Sequence: Synthetic oligonucleotide
uucaagccuuuaacccag

SEQ ID NO: 1188 - RNA, 18 nt, Artificial Sequence
  Description of Artificial Sequence: Synthetic oligonucleotide
gggccuucaagccuuuaa

SEQ ID NO: 1189 - RNA, 18 nt, Artificial Sequence
  Description of Artificial Sequence: Synthetic oligonucleotide
ccuagacuccuaacaggg

SEQ ID NO: 1190 - RNA, 18 nt, Artificial Sequence
  Description of Artificial Sequence: Synthetic oligonucleotide
ccccuagacuccuaacag

SEQ ID NO: 1191 - RNA, 18 nt, Artificial Sequence
  Description of Artificial Sequence: Synthetic oligonucleotide
ucucaccccuagacuccu

SEQ ID NO: 1192 - RNA, 18 nt, Artificial Sequence
  Description of Artificial Sequence: Synthetic oligonucleotide
gagaaucucaccccuaga

SEQ ID NO: 1193 - RNA, 18 nt, Artificial Sequence
  Description of Artificial Sequence: Synthetic oligonucleotide
gagaagagaaucucaccc

SEQ ID NO: 1194 - RNA, 18 nt, Artificial Sequence
  Description of Artificial Sequence: Synthetic oligonucleotide
ucagagagaagagaaucu

SEQ ID NO: 1195 - RNA, 18 nt, Artificial Sequence
  Description of Artificial Sequence: Synthetic oligonucleotide
ugggaucagagagaagag

SEQ ID NO: 1196 - RNA, 18 nt, Artificial Sequence
  Description of Artificial Sequence: Synthetic oligonucleotide
uccucugggaucagagag

SEQ ID NO: 1197 - RNA, 18 nt, Artificial Sequence
  Description of Artificial Sequence: Synthetic oligonucleotide
uaacguccucugggauca

SEQ ID NO: 1198 - RNA, 18 nt, Artificial Sequence
  Description of Artificial Sequence: Synthetic oligonucleotide
gaaguuaacguccucugg

SEQ ID NO: 1199 - RNA, 18 nt, Artificial Sequence
  Description of Artificial Sequence: Synthetic oligonucleotide
caguagaaguuaacgucc

SEQ ID NO: 1200 - RNA, 18 nt, Artificial Sequence
  Description of Artificial Sequence: Synthetic oligonucleotide
accugcaguagaaguuaa

SEQ ID NO: 1201 - RNA, 18 nt, Artificial Sequence
  Description of Artificial Sequence: Synthetic oligonucleotide
uucucaccugcaguagaa

SEQ ID NO: 1202 - RNA, 18 nt, Artificial Sequence
  Description of Artificial Sequence: Synthetic oligonucleotide
uuuguuucucaccugcag

SEQ ID NO: 1203 - RNA, 18 nt, Artificial Sequence
  Description of Artificial Sequence: Synthetic oligonucleotide
ccuauuuuguuucucacc

SEQ ID NO: 1204 - RNA, 18 nt, Artificial Sequence
  Description of Artificial Sequence: Synthetic oligonucleotide
auccuccuauuuuguuuc

SEQ ID NO: 1205 - RNA, 18 nt, Artificial Sequence
  Description of Artificial Sequence: Synthetic oligonucleotide
ccaccauccuccuauuuu

SEQ ID NO: 1206 - RNA, 18 nt, Artificial Sequence
  Description of Artificial Sequence: Synthetic oligonucleotide
aguccccaccauccuccu

SEQ ID NO: 1207 - RNA, 18 nt, Artificial Sequence
  Description of Artificial Sequence: Synthetic oligonucleotide
aggacaguccccaccauc

SEQ ID NO: 1208 - RNA, 18 nt, Artificial Sequence
  Description of Artificial Sequence: Synthetic oligonucleotide
cucccaggacagucccca

SEQ ID NO: 1209 - RNA, 18 nt, Artificial Sequence
  Description of Artificial Sequence: Synthetic oligonucleotide
cccuccucccaggacagu

SEQ ID NO: 1210 - RNA, 18 nt, Artificial Sequence
  Description of Artificial Sequence: Synthetic oligonucleotide
ccacccccuccucccagg

SEQ ID NO: 1211 - RNA, 18 nt, Artificial Sequence
  Description of Artificial Sequence: Synthetic oligonucleotide
auggaccacccccuccuc

SEQ ID NO: 1212 - RNA, 18 nt, Artificial Sequence
  Description of Artificial Sequence: Synthetic oligonucleotide
aagccauggaccaccccc

SEQ ID NO: 1213 - RNA, 18 nt, Artificial Sequence
  Description of Artificial Sequence: Synthetic oligonucleotide
accacaagccauggacca

SEQ ID NO: 1214 - RNA, 18 nt, Artificial Sequence
  Description of Artificial Sequence: Synthetic oligonucleotide
cccacaccacaagccaug

SEQ ID NO: 1215 - RNA, 18 nt, Artificial Sequence
  Description of Artificial Sequence: Synthetic oligonucleotide
gccagcccacaccacaag

SEQ ID NO: 1216 - RNA, 18 nt, Artificial Sequence
  Description of Artificial Sequence: Synthetic oligonucleotide
cuauagccagcccacacc

SEQ ID NO: 1217 - RNA, 18 nt, Artificial Sequence
  Description of Artificial Sequence: Synthetic oligonucleotide
cuccccuauagccagccc

SEQ ID NO: 1218 - RNA, 18 nt, Artificial Sequence
  Description of Artificial Sequence: Synthetic oligonucleotide
guggccuccccuauagcc

SEQ ID NO: 1219 - RNA, 18 nt, Artificial Sequence
  Description of Artificial Sequence: Synthetic oligonucleotide
uagcaguggccuccccua

SEQ ID NO: 1220 - RNA, 18 nt, Artificial Sequence
  Description of Artificial Sequence: Synthetic oligonucleotide
uccccuagcaguggccuc

SEQ ID NO: 1221 - RNA, 18 nt, Artificial Sequence
  Description of Artificial Sequence: Synthetic oligonucleotide
gccaguccccuagcagug

SEQ ID NO: 1222 - RNA, 18 nt, Artificial Sequence
  Description of Artificial Sequence: Synthetic oligonucleotide
uggaugccaguccccuag

SEQ ID NO: 1223 - RNA, 18 nt, Artificial Sequence
  Description of Artificial Sequence: Synthetic oligonucleotide
gggccuggaugccagucc

SEQ ID NO: 1224 - RNA, 18 nt, Artificial Sequence
  Description of Artificial Sequence: Synthetic oligonucleotide
auugagacgcuucaaggg

SEQ ID NO: 1225 - RNA, 18 nt, Artificial Sequence
  Description of Artificial Sequence: Synthetic oligonucleotide
uuauugagacgcuucaag

SEQ ID NO: 1226 - RNA, 18 nt, Artificial Sequence
  Description of Artificial Sequence: Synthetic oligonucleotide
cggacuuauugagacgcu

SEQ ID NO: 1227 - RNA, 18 nt, Artificial Sequence
  Description of Artificial Sequence: Synthetic oligonucleotide
gagcgcggacuuauugag

SEQ ID NO: 1228 - RNA, 18 nt, Artificial Sequence
  Description of Artificial Sequence: Synthetic oligonucleotide
aaggagagcgcggacuua

SEQ ID NO: 1229 - RNA, 18 nt, Artificial Sequence
  Description of Artificial Sequence: Synthetic oligonucleotide
gguuuguuggacccaagg

SEQ ID NO: 1230 - RNA, 18 nt, Artificial Sequence
  Description of Artificial Sequence: Synthetic oligonucleotide
acgcggguuuguuggacc

SEQ ID NO: 1231 - RNA, 18 nt, Artificial Sequence
  Description of Artificial Sequence: Synthetic oligonucleotide
gucacacgcggguuuguu

SEQ ID NO: 1232 - RNA, 18 nt, Artificial Sequence
  Description of Artificial Sequence: Synthetic oligonucleotide
ccagcgucacacgcgggu

SEQ ID NO: 1233 - RNA, 18 nt, Artificial Sequence
  Description of Artificial Sequence: Synthetic oligonucleotide
gggccagcgucacacgcg

SEQ ID NO: 1234 - RNA, 18 nt, Artificial Sequence
  Description of Artificial Sequence: Synthetic oligonucleotide
aggccauuccacgguggg

SEQ ID NO: 1235 - RNA, 18 nt, Artificial Sequence
  Description of Artificial Sequence: Synthetic oligonucleotide
gggccaggccauuccacg

SEQ ID NO: 1236 - RNA, 18 nt, Artificial Sequence
  Description of Artificial Sequence: Synthetic oligonucleotide
uccguaaucugcagccgg

SEQ ID NO: 1237 - RNA, 18 nt, Artificial Sequence
  Description of Artificial Sequence: Synthetic oligonucleotide
cguucuccguaaucugca

SEQ ID NO: 1238 - RNA, 18 nt, Artificial Sequence
  Description of Artificial Sequence: Synthetic oligonucleotide
cucgccguucuccguaau

SEQ ID NO: 1239 - RNA, 18 nt, Artificial Sequence
  Description of Artificial Sequence: Synthetic oligonucleotide
cggaacucgccguucucc

SEQ ID NO: 1240 - RNA, 18 nt, Artificial Sequence
  Description of Artificial Sequence: Synthetic oligonucleotide
uguuucggaacucgccgu

SEQ ID NO: 1241 - RNA, 18 nt, Artificial Sequence
  Description of Artificial Sequence: Synthetic oligonucleotide
ugcgguguuucggaacuc

SEQ ID NO: 1242 - RNA, 18 nt, Artificial Sequence
  Description of Artificial Sequence: Synthetic oligonucleotide
uggucugcgguguuucgg

SEQ ID NO: 1243 - RNA, 18 nt, Artificial Sequence
  Description of Artificial Sequence: Synthetic oligonucleotide
gcuaguggucugcggugu

SEQ ID NO: 1244 - RNA, 18 nt, Artificial Sequence
  Description of Artificial Sequence: Synthetic oligonucleotide
ggugggcuaguggucugc

SEQ ID NO: 1245 - RNA, 18 nt, Artificial Sequence
  Description of Artificial Sequence: Synthetic oligonucleotide
ugcugggugggcuagugg

SEQ ID NO: 1246 - RNA, 18 nt, Artificial Sequence
  Description of Artificial Sequence: Synthetic oligonucleotide
ucugaugcugggugggcu

SEQ ID NO: 1247 - RNA, 18 nt, Artificial Sequence
  Description of Artificial Sequence: Synthetic oligonucleotide
aggucucugaugcugggu

SEQ ID NO: 1248 - RNA, 18 nt, Artificial Sequence
  Description of Artificial Sequence: Synthetic oligonucleotide
agagaaggucucugaugc

SEQ ID NO: 1249 - RNA, 18 nt, Artificial Sequence
  Description of Artificial Sequence: Synthetic oligonucleotide
aaggaagagaaggucucu

SEQ ID NO: 1250 - RNA, 18 nt, Artificial Sequence
  Description of Artificial Sequence: Synthetic oligonucleotide
caggaaaggaagagaagg

SEQ ID NO: 1251 - RNA, 18 nt, Artificial Sequence
  Description of Artificial Sequence: Synthetic oligonucleotide
gugcacaggaaaggaaga

SEQ ID NO: 1252 - RNA, 18 nt, Artificial Sequence
  Description of Artificial Sequence: Synthetic oligonucleotide
gggugcacaggaaaggaa

SEQ ID NO: 1253 - RNA, 18 nt, Artificial Sequence
  Description of Artificial Sequence: Synthetic oligonucleotide
gugcuguuacaggguggg

SEQ ID NO: 1254 - RNA, 18 nt, Artificial Sequence
  Description of Artificial Sequence: Synthetic oligonucleotide
gguuggugcuguuacagg

SEQ ID NO: 1255 - RNA, 18 nt, Artificial Sequence
  Description of Artificial Sequence: Synthetic oligonucleotide
cuggugguuggugcuguu

SEQ ID NO: 1256 - RNA, 18 nt, Artificial Sequence
  Description of Artificial Sequence: Synthetic oligonucleotide
caauccuggugguuggug

SEQ ID NO: 1257 - RNA, 18 nt, Artificial Sequence
  Description of Artificial Sequence: Synthetic oligonucleotide
auguccaauccugguggu

SEQ ID NO: 1258 - RNA, 18 nt, Artificial Sequence
  Description of Artificial Sequence: Synthetic oligonucleotide
cggugauguccaauccug

SEQ ID NO: 1259 - RNA, 18 nt, Artificial Sequence
  Description of Artificial Sequence: Synthetic oligonucleotide
uuccucggugauguccaa

SEQ ID NO: 1260 - RNA, 18 nt, Artificial Sequence
  Description of Artificial Sequence: Synthetic oligonucleotide
cgcuguuccucggugaug

SEQ ID NO: 1261 - RNA, 18 nt, Artificial Sequence
  Description of Artificial Sequence: Synthetic oligonucleotide
aaucccgcuguuccucgg

SEQ ID NO: 1262 - RNA, 18 nt, Artificial Sequence
  Description of Artificial Sequence: Synthetic oligonucleotide
gaggcaaucccgcuguuc

SEQ ID NO: 1263 - RNA, 18 nt, Artificial Sequence
  Description of Artificial Sequence: Synthetic oligonucleotide
gggaggcaaucccgcugu

SEQ ID NO: 1264 - RNA, 18 nt, Artificial Sequence
  Description of Artificial Sequence: Synthetic oligonucleotide
cccagggaggcauucggg

SEQ ID NO: 1265 - RNA, 18 nt, Artificial Sequence
  Description of Artificial Sequence: Synthetic oligonucleotide
ugccucccagggaggcau

SEQ ID NO: 1266 - RNA, 18 nt, Artificial Sequence
  Description of Artificial Sequence: Synthetic oligonucleotide
cagugugccucccaggga

SEQ ID NO: 1267 - RNA, 18 nt, Artificial Sequence
  Description of Artificial Sequence: Synthetic oligonucleotide
gcaaucagugugccuccc

SEQ ID NO: 1268 - RNA, 18 nt, Artificial Sequence
  Description of Artificial Sequence: Synthetic oligonucleotide
ggugggcaaucagugugc

SEQ ID NO: 1269 - RNA, 18 nt, Artificial Sequence
  Description of Artificial Sequence: Synthetic oligonucleotide
gggugggcaaucagugug

SEQ ID NO: 1270 - RNA, 18 nt, Artificial Sequence
  Description of Artificial Sequence: Synthetic oligonucleotide
aaauggugcagugguggg

SEQ ID NO: 1271 - RNA, 18 nt, Artificial Sequence
  Description of Artificial Sequence: Synthetic oligonucleotide
ccuggaaauggugcagug

SEQ ID NO: 1272 - RNA, 18 nt, Artificial Sequence
  Description of Artificial Sequence: Synthetic oligonucleotide
ucccuccuggaaauggug

SEQ ID NO: 1273 - RNA, 18 nt, Artificial Sequence
  Description of Artificial Sequence: Synthetic oligonucleotide
cacucucccuccuggaaa

SEQ ID NO: 1274 - RNA, 18 nt, Artificial Sequence
  Description of Artificial Sequence: Synthetic oligonucleotide
guccccacucucccuccu

SEQ ID NO: 1275 - RNA, 18 nt, Artificial Sequence
  Description of Artificial Sequence: Synthetic oligonucleotide
ugaggguccccacucucc

SEQ ID NO: 1276 - RNA, 18 nt, Artificial Sequence
  Description of Artificial Sequence: Synthetic oligonucleotide
gcggcugaggguccccac

SEQ ID NO: 1277 - RNA, 18 nt, Artificial Sequence
  Description of Artificial Sequence: Synthetic oligonucleotide
gggcggcugagggucccc

SEQ ID NO: 1278 - RNA, 18 nt, Artificial Sequence
  Description of Artificial Sequence: Synthetic oligonucleotide
caaugggaaggaaaaggg

SEQ ID NO: 1279 - RNA, 18 nt, Artificial Sequence
  Description of Artificial Sequence: Synthetic oligonucleotide
caccccaaugggaaggaa

SEQ ID NO: 1280 - RNA, 18 nt, Artificial Sequence
  Description of Artificial Sequence: Synthetic oligonucleotide
ggcagcaccccaauggga

SEQ ID NO: 1281 - RNA, 18 nt, Artificial Sequence
  Description of Artificial Sequence: Synthetic oligonucleotide
gagagggcagcaccccaa

SEQ ID NO: 1282 - RNA, 18 nt, Artificial Sequence
  Description of Artificial Sequence: Synthetic oligonucleotide
ucaaagagagggcagcac

SEQ ID NO: 1283 - RNA, 18 nt, Artificial Sequence
  Description of Artificial Sequence: Synthetic oligonucleotide
gggucaaagagagggcag

SEQ ID NO: 1284 - RNA, 18 nt, Artificial Sequence
  Description of Artificial Sequence: Synthetic oligonucleotide
gguaggcgguguccuggg

SEQ ID NO: 1285 - RNA, 18 nt, Artificial Sequence
  Description of Artificial Sequence: Synthetic oligonucleotide
ggguaggcgguguccugg

SEQ ID NO: 1286 - RNA, 18 nt, Artificial Sequence
  Description of Artificial Sequence: Synthetic oligonucleotide
gcaccccggagugaaggg

SEQ ID NO: 1287 - RNA, 18 nt, Artificial Sequence
  Description of Artificial Sequence: Synthetic oligonucleotide
ggauagcaccccggagug

SEQ ID NO: 1288 - RNA, 18 nt, Artificial Sequence
  Description of Artificial Sequence: Synthetic oligonucleotide
gggauagcaccccggagu

SEQ ID NO: 1289 - RNA, 18 nt, Artificial Sequence
  Description of Artificial Sequence: Synthetic oligonucleotide
gaugaggcagaggauggg

SEQ ID NO: 1290 - RNA, 18 nt, Artificial Sequence
  Description of Artificial Sequence: Synthetic oligonucleotide
ggaacgaugaggcagagg

SEQ ID NO: 1291 - RNA, 18 nt, Artificial Sequence
  Description of Artificial Sequence: Synthetic oligonucleotide
gggaacgaugaggcagag

SEQ ID NO: 1292 - RNA, 18 nt, Artificial Sequence
  Description of Artificial Sequence: Synthetic oligonucleotide
gucccccagugcucaggg

SEQ ID NO: 1293 - RNA, 18 nt, Artificial Sequence
  Description of Artificial Sequence: Synthetic oligonucleotide
ggucugucccccagugcu

SEQ ID NO: 1294 - RNA, 18 nt, Artificial Sequence
  Description of Artificial Sequence: Synthetic oligonucleotide
gugagggucuguccccca

SEQ ID NO: 1295 - RNA, 18 nt, Artificial Sequence
  Description of Artificial Sequence: Synthetic oligonucleotide
gggugagggucugucccc

SEQ ID NO: 1296 - RNA, 18 nt, Artificial Sequence
  Description of Artificial Sequence: Synthetic oligonucleotide
ccacacccccaggguggg

SEQ ID NO: 1297 - RNA, 18 nt, Artificial Sequence
  Description of Artificial Sequence: Synthetic oligonucleotide
aggugccacacccccagg

SEQ ID NO: 1298 - RNA, 18 nt, Artificial Sequence
  Description of Artificial Sequence: Synthetic oligonucleotide
uuuggaggugccacaccc

SEQ ID NO: 1299 - RNA, 18 nt, Artificial Sequence
  Description of Artificial Sequence: Synthetic oligonucleotide
gaaaguuuggaggugcca

SEQ ID NO: 1300 - RNA, 18 nt, Artificial Sequence
  Description of Artificial Sequence: Synthetic oligonucleotide
aaguugaaaguuuggagg

SEQ ID NO: 1301 - RNA, 18 nt, Artificial Sequence
  Description of Artificial Sequence: Synthetic oligonucleotide
cccugaaguugaaaguuu

SEQ ID NO: 1302 - RNA, 18 nt, Artificial Sequence
  Description of Artificial Sequence: Synthetic oligonucleotide
aaucacccugaaguugaa

SEQ ID NO: 1303 - RNA, 18 nt, Artificial Sequence
  Description of Artificial Sequence: Synthetic oligonucleotide
aaaaaaaucacccugaag

SEQ ID NO: 1304 - RNA, 18 nt, Artificial Sequence
  Description of Artificial Sequence: Synthetic oligonucleotide
cugcuaaaaaaaucaccc

SEQ ID NO: 1305 - RNA, 18 nt, Artificial Sequence
  Description of Artificial Sequence: Synthetic oligonucleotide
gguuacugcuaaaaaaau

SEQ ID NO: 1306 - RNA, 18 nt, Artificial Sequence
  Description of Artificial Sequence: Synthetic oligonucleotide
gcucugguuacugcuaaa

SEQ ID NO: 1307 - RNA, 18 nt, Artificial Sequence
  Description of Artificial Sequence: Synthetic oligonucleotide
ugucagcucugguuacug

SEQ ID NO: 1308 - RNA, 18 nt, Artificial Sequence
  Description of Artificial Sequence: Synthetic oligonucleotide
uagauugucagcucuggu

SEQ ID NO: 1309 - RNA, 18 nt, Artificial Sequence
  Description of Artificial Sequence: Synthetic oligonucleotide
ggaguuagauugucagcu

SEQ ID NO: 1310 - RNA, 18 nt, Artificial Sequence
  Description of Artificial Sequence: Synthetic oligonucleotide
gggaguuagauugucagc

SEQ ID NO: 1311 - RNA, 18 nt, Artificial Sequence
  Description of Artificial Sequence: Synthetic oligonucleotide
cccuccccauaacaaggg

SEQ ID NO: 1312 - RNA, 18 nt, Artificial Sequence
  Description of Artificial Sequence: Synthetic oligonucleotide
ggguccccuccccauaac

SEQ ID NO: 1313 - RNA, 18 nt, Artificial Sequence
  Description of Artificial Sequence: Synthetic oligonucleotide
uaauagggcccccucacc

SEQ ID NO: 1314 - RNA, 18 nt, Artificial Sequence
  Description of Artificial Sequence: Synthetic oligonucleotide
ggguaauagggcccccuc

SEQ ID NO: 1315 - RNA, 18 nt, Artificial Sequence
  Description of Artificial Sequence: Synthetic oligonucleotide
cuccugagaaaucaaggg

SEQ ID NO: 1316 - RNA, 18 nt, Artificial Sequence
  Description of Artificial Sequence: Synthetic oligonucleotide
agacgcuccugagaaauc

SEQ ID NO: 1317 - RNA, 18 nt, Artificial Sequence
  Description of Artificial Sequence: Synthetic oligonucleotide
cccccagacgcuccugag

SEQ ID NO: 1318 - RNA, 18 nt, Artificial Sequence
  Description of Artificial Sequence: Synthetic oligonucleotide
gagcccccccagacgcuc

SEQ ID NO: 1319 - RNA, 18 nt, Artificial Sequence
  Description of Artificial Sequence: Synthetic oligonucleotide
gugcugagcccccccaga

SEQ ID NO: 1320 - RNA, 18 nt, Artificial Sequence
  Description of Artificial Sequence: Synthetic oligonucleotide
ugugcgugcugagccccc

SEQ ID NO: 1321 - RNA, 18 nt, Artificial Sequence
  Description of Artificial Sequence: Synthetic oligonucleotide
gaguuugugcgugcugag

SEQ ID NO: 1322 - RNA, 18 nt, Artificial Sequence
  Description of Artificial Sequence: Synthetic oligonucleotide
agaaggaguuugugcgug

SEQ ID NO: 1323 - RNA, 18 nt, Artificial Sequence
  Description of Artificial Sequence: Synthetic oligonucleotide
gaaggagaaggaguuugu

SEQ ID NO: 1324 - RNA, 18 nt, Artificial Sequence
  Description of Artificial Sequence: Synthetic oligonucleotide
ugguagaaggagaaggag

SEQ ID NO: 1325 - RNA, 18 nt, Artificial Sequence
  Description of Artificial Sequence: Synthetic oligonucleotide
aagagugguagaaggaga

SEQ ID NO: 1326 - RNA, 18 nt, Artificial Sequence
  Description of Artificial Sequence: Synthetic oligonucleotide
aauuuaagagugguagaa

SEQ ID NO: 1327 - RNA, 18 nt, Artificial Sequence
  Description of Artificial Sequence: Synthetic oligonucleotide
gaguaaauuuaagagugg

SEQ ID NO: 1328 - RNA, 18 nt, Artificial Sequence
  Description of Artificial Sequence: Synthetic oligonucleotide
ggagggaguaaauuuaag

SEQ ID NO: 1329 - RNA, 18 nt, Artificial Sequence
  Description of Artificial Sequence: Synthetic oligonucleotide
gggagggaguaaauuuaa

SEQ ID NO: 1330 - RNA, 18 nt, Artificial Sequence
  Description of Artificial Sequence: Synthetic oligonucleotide
aucuggguucuggguggg

SEQ ID NO: 1331 - RNA, 18 nt, Artificial Sequence
  Description of Artificial Sequence: Synthetic oligonucleotide
accccaucuggguucugg

SEQ ID NO: 1332 - RNA, 18 nt, Artificial Sequence
  Description of Artificial Sequence: Synthetic oligonucleotide
ccuccaccccaucugggu

SEQ ID NO: 1333 - RNA, 18 nt, Artificial Sequence
  Description of Artificial Sequence: Synthetic oligonucleotide
ggcccccuccaccccauc

SEQ ID NO: 1334 - RNA, 18 nt, Artificial Sequence
  Description of Artificial Sequence: Synthetic oligonucleotide
ccgguggcccccuccacc

SEQ ID NO: 1335 - RNA, 18 nt, Artificial Sequence
  Description of Artificial Sequence: Synthetic oligonucleotide
cugccccgguggcccccu

SEQ ID NO: 1336 - RNA, 18 nt, Artificial Sequence
  Description of Artificial Sequence: Synthetic oligonucleotide
ccucccugccccgguggc

SEQ ID NO: 1337 - RNA, 18 nt, Artificial Sequence
  Description of Artificial Sequence: Synthetic oligonucleotide
cgcccccucccugccccg

SEQ ID NO: 1338 - RNA, 18 nt, Artificial Sequence
  Description of Artificial Sequence: Synthetic oligonucleotide
cuugccgcccccucccug

SEQ ID NO: 1339 - RNA, 18 nt, Artificial Sequence
  Description of Artificial Sequence: Synthetic oligonucleotide
ccccccuugccgcccccu

SEQ ID NO: 1340 - RNA, 18 nt, Artificial Sequence
  Description of Artificial Sequence: Synthetic oligonucleotide
ccauuccccccuugccgc

SEQ ID NO: 1341 - RNA, 18 nt, Artificial Sequence
  Description of Artificial Sequence: Synthetic oligonucleotide
aacucccauuccccccuu

SEQ ID NO: 1342 - RNA, 18 nt, Artificial Sequence
  Description of Artificial Sequence: Synthetic oligonucleotide
gagacaacucccauuccc

SEQ ID NO: 1343 - RNA, 18 nt, Artificial Sequence
  Description of Artificial Sequence: Synthetic oligonucleotide
gggagacaacucccauuc

SEQ ID NO: 1344 - RNA, 18 nt, Artificial Sequence
  Description of Artificial Sequence: Synthetic oligonucleotide
gagcagaucagguguggg

SEQ ID NO: 1345 - RNA, 18 nt, Artificial Sequence
  Description of Artificial Sequence: Synthetic oligonucleotide
gccgagagcagaucaggu

SEQ ID NO: 1346 - RNA, 18 nt, Artificial Sequence
  Description of Artificial Sequence: Synthetic oligonucleotide
gaccagccgagagcagau

SEQ ID NO: 1347 - RNA, 18 nt, Artificial Sequence
  Description of Artificial Sequence: Synthetic oligonucleotide
ucugggaccagccgagag

SEQ ID NO: 1348 - RNA, 18 nt, Artificial Sequence
  Description of Artificial Sequence: Synthetic oligonucleotide
cccgcucugggaccagcc

SEQ ID NO: 1349 - RNA, 18 nt, Artificial Sequence
  Description of Artificial Sequence: Synthetic oligonucleotide
cucaccccgcucugggac

SEQ ID NO: 1350 - RNA, 18 nt, Artificial Sequence
  Description of Artificial Sequence: Synthetic oligonucleotide
gcccccucaccccgcucu

SEQ ID NO: 1351 - RNA, 18 nt, Artificial Sequence
  Description of Artificial Sequence: Synthetic oligonucleotide
cauaagcccccucacccc

SEQ ID NO: 1352 - RNA, 18 nt, Artificial Sequence
  Description of Artificial Sequence: Synthetic oligonucleotide
gggcauaagcccccucac

SEQ ID NO: 1353 - RNA, 18 nt, Artificial Sequence
  Description of Artificial Sequence: Synthetic oligonucleotide
cccacccaacacacuggg

SEQ ID NO: 1354 - RNA, 18 nt, Artificial Sequence
  Description of Artificial Sequence: Synthetic oligonucleotide
uccaccccacccaacaca

SEQ ID NO: 1355 - RNA, 18 nt, Artificial Sequence
  Description of Artificial Sequence: Synthetic oligonucleotide
ucaauuccaccccaccca

SEQ ID NO: 1356 - RNA, 18 nt, Artificial Sequence
  Description of Artificial Sequence: Synthetic oligonucleotide
uaaccucaauuccacccc

SEQ ID NO: 1357 - RNA, 18 nt, Artificial Sequence
  Description of Artificial Sequence: Synthetic oligonucleotide
cacccuaaccucaauucc

SEQ ID NO: 1358 - RNA, 18 nt, Artificial Sequence
  Description of Artificial Sequence: Synthetic oligonucleotide
ccccucacccuaaccuca

SEQ ID NO: 1359 - RNA, 18 nt, Artificial Sequence
  Description of Artificial Sequence: Synthetic oligonucleotide
ccugaccccucacccuaa

SEQ ID NO: 1360 - RNA, 18 nt, Artificial Sequence
  Description of Artificial Sequence: Synthetic oligonucleotide
uaaacccugaccccucac

SEQ ID NO: 1361 - RNA, 18 nt, Artificial Sequence
  Description of Artificial Sequence: Synthetic oligonucleotide
ccuccuaaacccugaccc

SEQ ID NO: 1362 - RNA, 18 nt, Artificial Sequence
  Description of Artificial Sequence: Synthetic oligonucleotide
cacacccuccuaaacccu

SEQ ID NO: 1363 - RNA, 18 nt, Artificial Sequence
  Description of Artificial Sequence: Synthetic oligonucleotide
acauacacacccuccuaa

SEQ ID NO: 1364 - RNA, 18 nt, Artificial Sequence
  Description of Artificial Sequence: Synthetic oligonucleotide
ucccaacauacacacccu

SEQ ID NO: 1365 - RNA, 18 nt, Artificial Sequence
  Description of Artificial Sequence: Synthetic oligonucleotide
uguccucccaacauacac

SEQ ID NO: 1366 - RNA, 18 nt, Artificial Sequence
  Description of Artificial Sequence: Synthetic oligonucleotide
uagccuguccucccaaca

SEQ ID NO: 1367 - RNA, 18 nt, Artificial Sequence
  Description of Artificial Sequence: Synthetic oligonucleotide
ucaacuagccuguccucc

SEQ ID NO: 1368 - RNA, 18 nt, Artificial Sequence
  Description of Artificial Sequence: Synthetic oligonucleotide
acagaucaacuagccugu

SEQ ID NO: 1369 - RNA, 18 nt, Artificial Sequence
  Description of Artificial Sequence: Synthetic oligonucleotide
guaggacagaucaacuag

SEQ ID NO: 1370 - RNA, 18 nt, Artificial Sequence
  Description of Artificial Sequence: Synthetic oligonucleotide
ucagaguaggacagauca

SEQ ID NO: 1371 - RNA, 18 nt, Artificial Sequence
  Description of Artificial Sequence: Synthetic oligonucleotide
gugugucagaguaggaca

SEQ ID NO: 1372 - RNA, 18 nt, Artificial Sequence
  Description of Artificial Sequence: Synthetic oligonucleotide
ggacugugugucagagua

SEQ ID NO: 1373 - RNA, 18 nt, Artificial Sequence
  Description of Artificial Sequence: Synthetic oligonucleotide
gggacugugugucagagu

SEQ ID NO: 1374 - RNA, 18 nt, Artificial Sequence
  Description of Artificial Sequence: Synthetic oligonucleotide
agaagagagaaggaaggg

SEQ ID NO: 1375 - RNA, 18 nt, Artificial Sequence
  Description of Artificial Sequence: Synthetic oligonucleotide
gaccaagaagagagaagg

SEQ ID NO: 1376 - RNA, 18 nt, Artificial Sequence
  Description of Artificial Sequence: Synthetic oligonucleotide
guagagaccaagaagaga

SEQ ID NO: 1377 - RNA, 18 nt, Artificial Sequence
  Description of Artificial Sequence: Synthetic oligonucleotide
ugggaguagagaccaaga

SEQ ID NO: 1378 - RNA, 18 nt, Artificial Sequence
  Description of Artificial Sequence: Synthetic oligonucleotide
cccccugggaguagagac

SEQ ID NO: 1379 - RNA, 18 nt, Artificial Sequence
  Description of Artificial Sequence: Synthetic oligonucleotide
ccccucccccugggagua

SEQ ID NO: 1380 - RNA, 18 nt, Artificial Sequence
  Description of Artificial Sequence: Synthetic oligonucleotide
guuccccccucccccugg

SEQ ID NO: 1381 - RNA, 18 nt, Artificial Sequence
  Description of Artificial Sequence: Synthetic oligonucleotide
aguaaguuccccccuccc

SEQ ID NO: 1382 - RNA, 18 nt, Artificial Sequence
  Description of Artificial Sequence: Synthetic oligonucleotide
ccuagaguaaguuccccc

SEQ ID NO: 1383 - RNA, 18 nt, Artificial Sequence
  Description of Artificial Sequence: Synthetic oligonucleotide
cuuuuccuagaguaaguu

SEQ ID NO: 1384 - RNA, 18 nt, Artificial Sequence
  Description of Artificial Sequence: Synthetic oligonucleotide
cauggcuuuuccuagagu

SEQ ID NO: 1385 - RNA, 18 nt, Artificial Sequence
  Description of Artificial Sequence: Synthetic oligonucleotide
agagacauggcuuuuccu

SEQ ID NO: 1386 - RNA, 18 nt, Artificial Sequence
  Description of Artificial Sequence: Synthetic oligonucleotide
gggagagagacauggcuu

SEQ ID NO: 1387 - RNA, 18 nt, Artificial Sequence
  Description of Artificial Sequence: Synthetic oligonucleotide
cacagguccccccacccu

SEQ ID NO: 1388 - RNA, 18 nt, Artificial Sequence
  Description of Artificial Sequence: Synthetic oligonucleotide
uccaacacaggucccccc

SEQ ID NO: 1389 - RNA, 18 nt, Artificial Sequence
  Description of Artificial Sequence: Synthetic oligonucleotide
ccuccuccaacacagguc

SEQ ID NO: 1390 - RNA, 18 nt, Artificial Sequence
  Description of Artificial Sequence: Synthetic oligonucleotide
acaccccuccuccaacac

SEQ ID NO: 1391 - RNA, 18 nt, Artificial Sequence
  Description of Artificial Sequence: Synthetic oligonucleotide
ccccaacaccccuccucc

SEQ ID NO: 1392 - RNA, 18 nt, Artificial Sequence
  Description of Artificial Sequence: Synthetic oligonucleotide
gggccccccaacaccccu

SEQ ID NO: 1393 - RNA, 18 nt, Artificial Sequence
  Description of Artificial Sequence: Synthetic oligonucleotide
gggacagagucauggaag

SEQ ID NO: 1394 - RNA, 18 nt, Artificial Sequence
  Description of Artificial Sequence: Synthetic oligonucleotide
guccuaccucccccaggg

SEQ ID NO: 1395 - RNA, 18 nt, Artificial Sequence
  Description of Artificial Sequence: Synthetic oligonucleotide
gcccuguccuaccucccc

SEQ ID NO: 1396 - RNA, 18 nt, Artificial Sequence
  Description of Artificial Sequence: Synthetic oligonucleotide
gcccagcccuguccuacc

SEQ ID NO: 1397 - RNA, 18 nt, Artificial Sequence
  Description of Artificial Sequence: Synthetic oligonucleotide
gggaagcccagcccuguc

SEQ ID NO: 1398 - RNA, 18 nt, Artificial Sequence
  Description of Artificial Sequence: Synthetic oligonucleotide
ugagagggaagcccagcc

SEQ ID NO: 1399 - RNA, 18 nt, Artificial Sequence
  Description of Artificial Sequence: Synthetic oligonucleotide
gaggaugagagggaagcc

SEQ ID NO: 1400 - RNA, 18 nt, Artificial Sequence
  Description of Artificial Sequence: Synthetic oligonucleotide
gggaggaugagagggaag

SEQ ID NO: 1401 - RNA, 18 nt, Artificial Sequence
  Description of Artificial Sequence: Synthetic oligonucleotide
ggaaggagauugggaggg

SEQ ID NO: 1402 - RNA, 18 nt, Artificial Sequence
  Description of Artificial Sequence: Synthetic oligonucleotide
gagguggaaggagauugg

SEQ ID NO: 1403 - RNA, 18 nt, Artificial Sequence
  Description of Artificial Sequence: Synthetic oligonucleotide
ggagggagguggaaggag

SEQ ID NO: 1404 - RNA, 18 nt, Artificial Sequence
  Description of Artificial Sequence: Synthetic oligonucleotide
gggagggagggaggugga

SEQ ID NO: 1405 - RNA, 18 nt, Artificial Sequence
  Description of Artificial Sequence: Synthetic oligonucleotide
cuggcgggagggagggag

SEQ ID NO: 1406 - RNA, 18 nt, Artificial Sequence
  Description of Artificial Sequence: Synthetic oligonucleotide
uggagcuggcgggaggga

SEQ ID NO: 1407 - RNA, 18 nt, Artificial Sequence
  Description of Artificial Sequence: Synthetic oligonucleotide
aaucguggagcuggcggg

SEQ ID NO: 1408 - RNA, 18 nt, Artificial Sequence
  Description of Artificial Sequence: Synthetic oligonucleotide
cgaaaaaucguggagcug

SEQ ID NO: 1409 - RNA, 18 nt, Artificial Sequence
  Description of Artificial Sequence: Synthetic oligonucleotide
aacaccgaaaaaucgugg

SEQ ID NO: 1410 - RNA, 18 nt, Artificial Sequence
  Description of Artificial Sequence: Synthetic oligonucleotide
agagaaacaccgaaaaau

SEQ ID NO: 1411 - RNA, 18 nt, Artificial Sequence
  Description of Artificial Sequence: Synthetic oligonucleotide
uguacagagaaacaccga

SEQ ID NO: 1412 - RNA, 18 nt, Artificial Sequence
  Description of Artificial Sequence: Synthetic oligonucleotide
aacuauguacagagaaac

SEQ ID NO: 1413 - RNA, 18 nt, Artificial Sequence
  Description of Artificial Sequence: Synthetic oligonucleotide
cagaaaacuauguacaga

SEQ ID NO: 1414 - RNA, 18 nt, Artificial Sequence
  Description of Artificial Sequence: Synthetic oligonucleotide
cccgccagaaaacuaugu

SEQ ID NO: 1415 - RNA, 18 nt, Artificial Sequence
  Description of Artificial Sequence: Synthetic oligonucleotide
ccuaucccgccagaaaac

SEQ ID NO: 1416 - RNA, 18 nt, Artificial Sequence
  Description of Artificial Sequence: Synthetic oligonucleotide
ccuccccuaucccgccag

SEQ ID NO: 1417 - RNA, 18 nt, Artificial Sequence
  Description of Artificial Sequence: Synthetic oligonucleotide
uccuaccuccccuauccc

SEQ ID NO: 1418 - RNA, 18 nt, Artificial Sequence
  Description of Artificial Sequence: Synthetic oligonucleotide
auccauccuaccuccccu

SEQ ID NO: 1419 - RNA, 18 nt, Artificial Sequence
  Description of Artificial Sequence: Synthetic oligonucleotide
accccauccauccuaccu

SEQ ID NO: 1420 - RNA, 18 nt, Artificial Sequence
  Description of Artificial Sequence: Synthetic oligonucleotide
cccaaaccccauccaucc

SEQ ID NO: 1421 - RNA, 18 nt, Artificial Sequence
  Description of Artificial Sequence: Synthetic oligonucleotide
cccaccccaaaccccauc

SEQ ID NO: 1422 - RNA, 18 nt, Artificial Sequence
  Description of Artificial Sequence: Synthetic oligonucleotide
gccuacccaccccaaacc

SEQ ID NO: 1423 - RNA, 18 nt, Artificial Sequence
  Description of Artificial Sequence: Synthetic oligonucleotide
ccauggccuacccacccc

SEQ ID NO: 1424 - RNA, 18 nt, Artificial Sequence
  Description of Artificial Sequence: Synthetic oligonucleotide
cccucccauggccuaccc

SEQ ID NO: 1425 - RNA, 18 nt, Artificial Sequence
  Description of Artificial Sequence: Synthetic oligonucleotide
uucuccccucccauggcc

SEQ ID NO: 1426 - RNA, 18 nt, Artificial Sequence
  Description of Artificial Sequence: Synthetic oligonucleotide
gggcuucuccccucccau

SEQ ID NO: 1427 - RNA, 18 nt, Artificial Sequence
  Description of Artificial Sequence: Synthetic oligonucleotide
agcagucagggaagaggg

SEQ ID NO: 1428 - RNA, 18 nt, Artificial Sequence
  Description of Artificial Sequence: Synthetic oligonucleotide
gggacagcagucagggaa

SEQ ID NO: 1429 - RNA, 18 nt, Artificial Sequence
  Description of Artificial Sequence: Synthetic oligonucleotide
gggcaaggcuggguaggg

SEQ ID NO: 1430 - RNA, 18 nt, Artificial Sequence
  Description of Artificial Sequence: Synthetic oligonucleotide
acgcaaaaggaugaaggg

SEQ ID NO: 1431 - RNA, 18 nt, Artificial Sequence
  Description of Artificial Sequence: Synthetic oligonucleotide
accaaacgcaaaaggaug

SEQ ID NO: 1432 - RNA, 18 nt, Artificial Sequence
  Description of Artificial Sequence: Synthetic oligonucleotide
ucaauaccaaacgcaaaa

SEQ ID NO: 1433 - RNA, 18 nt, Artificial Sequence
  Description of Artificial Sequence: Synthetic oligonucleotide
gagucucaauaccaaacg

SEQ ID NO: 1434 - RNA, 18 nt, Artificial Sequence
  Description of Artificial Sequence: Synthetic oligonucleotide
uaggagagucucaauacc

SEQ ID NO: 1435 - RNA, 18 nt, Artificial Sequence
  Description of Artificial Sequence: Synthetic oligonucleotide
gagucuaggagagucuca

SEQ ID NO: 1436 - RNA, 18 nt, Artificial Sequence
  Description of Artificial Sequence: Synthetic oligonucleotide
gaguagagucuaggagag

SEQ ID NO: 1437 - RNA, 18 nt, Artificial Sequence
  Description of Artificial Sequence: Synthetic oligonucleotide
aagaggaguagagucuag

SEQ ID NO: 1438 - RNA, 18 nt, Artificial Sequence
  Description of Artificial Sequence: Synthetic oligonucleotide
aaagaaagaggaguagag

SEQ ID NO: 1439 - RNA, 18 nt, Artificial Sequence
  Description of Artificial Sequence: Synthetic oligonucleotide
auacaaaagaaagaggag

SEQ ID NO: 1440 - RNA, 18 nt, Artificial Sequence
  Description of Artificial Sequence: Synthetic oligonucleotide
uguccauacaaaagaaag

SEQ ID NO: 1441 - RNA, 18 nt, Artificial Sequence
  Description of Artificial Sequence: Synthetic oligonucleotide
ggaacuguccauacaaaa

SEQ ID NO: 1442 - RNA, 18 nt, Artificial Sequence
  Description of Artificial Sequence: Synthetic oligonucleotide
gggaacuguccauacaaa

SEQ ID NO: 1443 - RNA, 18 nt, Artificial Sequence
  Description of Artificial Sequence: Synthetic oligonucleotide
cuggguguauguguaggg

SEQ ID NO: 1444 - RNA, 18 nt, Artificial Sequence
  Description of Artificial Sequence: Synthetic oligonucleotide
cccggcuggguguaugug

SEQ ID NO: 1445 - RNA, 18 nt, Artificial Sequence
  Description of Artificial Sequence: Synthetic oligonucleotide
uuggccccggcugggugu

SEQ ID NO: 1446 - RNA, 18 nt, Artificial Sequence
  Description of Artificial Sequence: Synthetic oligonucleotide
uaaauuuggccccggcug

SEQ ID NO: 1447 - RNA, 18 nt, Artificial Sequence
  Description of Artificial Sequence: Synthetic oligonucleotide
aaguauaaauuuggcccc

SEQ ID NO: 1448 - RNA, 18 nt, Artificial Sequence
  Description of Artificial Sequence: Synthetic oligonucleotide
uauauaaguauaaauuug

SEQ ID NO: 1449 - RNA, 18 nt, Artificial Sequence
  Description of Artificial Sequence: Synthetic oligonucleotide
acuuuuauauaaguauaa

SEQ ID NO: 1450 - RNA, 18 nt, Artificial Sequence
  Description of Artificial Sequence: Synthetic oligonucleotide
uuacaacuuuuauauaag

SEQ ID NO: 1451 - RNA, 18 nt, Artificial Sequence
  Description of Artificial Sequence: Synthetic oligonucleotide
cauauuuacaacuuuuau

SEQ ID NO: 1452 - RNA, 18 nt, Artificial Sequence
  Description of Artificial Sequence: Synthetic oligonucleotide
uuucacauauuuacaacu

SEQ ID NO: 1453 - RNA, 18 nt, Artificial Sequence
  Description of Artificial Sequence: Synthetic oligonucleotide
uaaaauuucacauauuua

SEQ ID NO: 1454 - RNA, 18 nt, Artificial Sequence
  Description of Artificial Sequence: Synthetic oligonucleotide
agggauaaaauuucacau

SEQ ID NO: 1455 - RNA, 18 nt, Artificial Sequence
  Description of Artificial Sequence: Synthetic oligonucleotide
ggcacagggauaaaauuu

SEQ ID NO: 1456 - RNA, 18 nt, Artificial Sequence
  Description of Artificial Sequence: Synthetic oligonucleotide
gaaagggcacagggauaa

SEQ ID NO: 1457 - RNA, 18 nt, Artificial Sequence
  Description of Artificial Sequence: Synthetic oligonucleotide
gggaaagggcacagggau

SEQ ID NO: 1458 - RNA, 18 nt, Artificial Sequence
  Description of Artificial Sequence: Synthetic oligonucleotide
gguagggccugagguggg

SEQ ID NO: 1459 - RNA, 18 nt, Artificial Sequence
  Description of Artificial Sequence: Synthetic oligonucleotide
ggguagggccugaggugg

SEQ ID NO: 1460 - RNA, 18 nt, Artificial Sequence
  Description of Artificial Sequence: Synthetic oligonucleotide
gagagaaggaagguuggg

SEQ ID NO: 1461 - RNA, 18 nt, Artificial Sequence
  Description of Artificial Sequence: Synthetic oligonucleotide
aagaagagagaaggaagg

SEQ ID NO: 1462 - RNA, 18 nt, Artificial Sequence
  Description of Artificial Sequence: Synthetic oligonucleotide
agccaaagaagagagaag

SEQ ID NO: 1463 - RNA, 18 nt, Artificial Sequence
  Description of Artificial Sequence: Synthetic oligonucleotide
acaacagccaaagaagag

SEQ ID NO: 1464 - RNA, 18 nt, Artificial Sequence
  Description of Artificial Sequence: Synthetic oligonucleotide
uaauuacaacagccaaag

SEQ ID NO: 1465 - RNA, 18 nt, Artificial Sequence
  Description of Artificial Sequence: Synthetic oligonucleotide
ccagauaauuacaacagc

SEQ ID NO: 1466 - RNA, 18 nt, Artificial Sequence
  Description of Artificial Sequence: Synthetic oligonucleotide
aaaccccagauaauuaca

SEQ ID NO: 1467 - RNA, 18 nt, Artificial Sequence
  Description of Artificial Sequence: Synthetic oligonucleotide
aguacaaaccccagauaa

SEQ ID NO: 1468 - RNA, 18 nt, Artificial Sequence
  Description of Artificial Sequence: Synthetic oligonucleotide
uguacaguacaaacccca

SEQ ID NO: 1469 - RNA, 18 nt, Artificial Sequence
  Description of Artificial Sequence: Synthetic oligonucleotide
ggauauguacaguacaaa

SEQ ID NO: 1470 - RNA, 18 nt, Artificial Sequence
  Description of Artificial Sequence: Synthetic oligonucleotide
accccggauauguacagu

SEQ ID NO: 1471 - RNA, 18 nt, Artificial Sequence
  Description of Artificial Sequence: Synthetic oligonucleotide
cacacaccccggauaugu

SEQ ID NO: 1472 - RNA, 18 nt, Artificial Sequence
  Description of Artificial Sequence: Synthetic oligonucleotide
acacacacacaccccgga

SEQ ID NO: 1473 - RNA, 18 nt, Artificial Sequence
  Description of Artificial Sequence: Synthetic oligonucleotide
agcccacacacacacacc

SEQ ID NO: 1474 - RNA, 18 nt, Artificial Sequence
  Description of Artificial Sequence: Synthetic oligonucleotide
cccccagcccacacacac

SEQ ID NO: 1475 - RNA, 18 nt, Artificial Sequence
  Description of Artificial Sequence: Synthetic oligonucleotide
gguugcccccagcccaca

SEQ ID NO: 1476 - RNA, 18 nt, Artificial Sequence
  Description of Artificial Sequence: Synthetic oligonucleotide
agaaggguugcccccagc

SEQ ID NO: 1477 - RNA, 18 nt, Artificial Sequence
  Description of Artificial Sequence: Synthetic oligonucleotide
uguacagaaggguugccc

SEQ ID NO: 1478 - RNA, 18 nt, Artificial Sequence
  Description of Artificial Sequence: Synthetic oligonucleotide
agcucuguacagaagggu

SEQ ID NO: 1479 - RNA, 18 nt, Artificial Sequence
  Description of Artificial Sequence: Synthetic oligonucleotide
caggaagcucuguacaga

SEQ ID NO: 1480 - RNA, 18 nt, Artificial Sequence
  Description of Artificial Sequence: Synthetic oligonucleotide
gggccaggaagcucugua

SEQ ID NO: 1481 - RNA, 18 nt, Artificial Sequence
  Description of Artificial Sequence: Synthetic oligonucleotide
cuugaggugguggguggg

SEQ ID NO: 1482 - RNA, 18 nt, Artificial Sequence
  Description of Artificial Sequence: Synthetic oligonucleotide
cuacccuugagguggugg

SEQ ID NO: 1483 - RNA, 18 nt, Artificial Sequence
  Description of Artificial Sequence: Synthetic oligonucleotide
acucccuacccuugaggu

SEQ ID NO: 1484 - RNA, 18 nt, Artificial Sequence
  Description of Artificial Sequence: Synthetic oligonucleotide
gagcaacucccuacccuu

SEQ ID NO: 1485 - RNA, 18 nt, Artificial Sequence
  Description of Artificial Sequence: Synthetic oligonucleotide
aggaagagcaacucccua

SEQ ID NO: 1486 - RNA, 18 nt, Artificial Sequence
  Description of Artificial Sequence: Synthetic oligonucleotide
cagguaggaagagcaacu

SEQ ID NO: 1487 - RNA, 18 nt, Artificial Sequence
  Description of Artificial Sequence: Synthetic oligonucleotide
uaaaacagguaggaagag

SEQ ID NO: 1488 - RNA, 18 nt, Artificial Sequence
  Description of Artificial Sequence: Synthetic oligonucleotide
caaaauaaaacagguagg

SEQ ID NO: 1489 - RNA, 18 nt, Artificial Sequence
  Description of Artificial Sequence: Synthetic oligonucleotide
gaaaacaaaauaaaacag

SEQ ID NO: 1490 - RNA, 18 nt, Artificial Sequence
  Description of Artificial Sequence: Synthetic oligonucleotide
aacgagaaaacaaaauaa

SEQ ID NO: 1491 - RNA, 18 nt, Artificial Sequence
  Description of Artificial Sequence: Synthetic oligonucleotide
gggagaacgagaaaacaa

SEQ ID NO: 1492 - RNA, 18 nt, Artificial Sequence
  Description of Artificial Sequence: Synthetic oligonucleotide
gggagggagaacgagaaa

SEQ ID NO: 1493 - RNA, 18 nt, Artificial Sequence
  Description of Artificial Sequence: Synthetic oligonucleotide
gauaaggcugggaguggg

SEQ ID NO: 1494 - RNA, 18 nt, Artificial Sequence
  Description of Artificial Sequence: Synthetic oligonucleotide
ggauagauaaggcuggga

SEQ ID NO: 1495 - RNA, 18 nt, Artificial Sequence
  Description of Artificial Sequence: Synthetic oligonucleotide
gggauagauaaggcuggg

SEQ ID NO: 1496 - RNA, 18 nt, Artificial Sequence
  Description of Artificial Sequence: Synthetic oligonucleotide
ugggaguggagaaaaggg

SEQ ID NO: 1497 - RNA, 18 nt, Artificial Sequence
  Description of Artificial Sequence: Synthetic oligonucleotide
gggcugggaguggagaaa

SEQ ID NO: 1498 - RNA, 18 nt, Artificial Sequence
  Description of Artificial Sequence: Synthetic oligonucleotide
agaaaaaaaggaaauggg

SEQ ID NO: 1499 - RNA, 18 nt, Artificial Sequence
  Description of Artificial Sequence: Synthetic oligonucleotide
acuccagaaaaaaaggaa

SEQ ID NO: 1500 - RNA, 18 nt, Artificial Sequence
  Description of Artificial Sequence: Synthetic oligonucleotide
cacacacuccagaaaaaa

SEQ ID NO: 1501 - RNA, 18 nt, Artificial Sequence
  Description of Artificial Sequence: Synthetic oligonucleotide
uucaccacacacuccaga

SEQ ID NO: 1502 - RNA, 18 nt, Artificial Sequence
  Description of Artificial Sequence: Synthetic oligonucleotide
ucuguuucaccacacacu

SEQ ID NO: 1503 - RNA, 18 nt, Artificial Sequence
  Description of Artificial Sequence: Synthetic oligonucleotide
uuuuuucuguuucaccac

SEQ ID NO: 1504 - RNA, 18 nt, Artificial Sequence
  Description of Artificial Sequence: Synthetic oligonucleotide
cauguuuuuuucuguuuc

SEQ ID NO: 1505 - RNA, 18 nt, Artificial Sequence
  Description of Artificial Sequence: Synthetic oligonucleotide
uuaaacauguuuuuuucu

SEQ ID NO: 1506 - RNA, 18 nt, Artificial Sequence
  Description of Artificial Sequence: Synthetic oligonucleotide
guuuauuaaacauguuuu

SEQ ID NO: 1507 - RNA, 18 nt, Artificial Sequence
  Description of Artificial Sequence: Synthetic oligonucleotide
ucuccguuuauuaaacau

SEQ ID NO: 1508 - RNA, 18 nt, Artificial Sequence
  Description of Artificial Sequence: Synthetic oligonucleotide
aacaaucuccguuuauua

SEQ ID NO: 1509 - RNA, 18 nt, Artificial Sequence
  Description of Artificial Sequence: Synthetic oligonucleotide
aaaagaacaaucuccguu

SEQ ID NO: 1510 - RNA, 18 nt, Artificial Sequence
  Description of Artificial Sequence: Synthetic oligonucleotide
gcgagccauguccauaga

SEQ ID NO: 1511 - RNA, 18 nt, Artificial Sequence
  Description of Artificial Sequence: Synthetic oligonucleotide
gggaggcgagccaugucc

SEQ ID NO: 1512 - RNA, 18 nt, Artificial Sequence
  Description of Artificial Sequence: Synthetic oligonucleotide
ggcuuuuccuugguuggg

SEQ ID NO: 1513 - RNA, 18 nt, Artificial Sequence
  Description of Artificial Sequence: Synthetic oligonucleotide
ggguggcuuuuccuuggu

SEQ ID NO: 1514 - RNA, 18 nt, Artificial Sequence
  Description of Artificial Sequence: Synthetic oligonucleotide
ccaccaggcggugguggg

SEQ ID NO: 1515 - RNA, 18 nt, Artificial Sequence
  Description of Artificial Sequence: Synthetic oligonucleotide
accaccaccaggcggugg

SEQ ID NO: 1516 - RNA, 18 nt, Artificial Sequence
  Description of Artificial Sequence: Synthetic oligonucleotide
ucuuuaccaccaccaggc

SEQ ID NO: 1517 - RNA, 18 nt, Artificial Sequence
  Description of Artificial Sequence: Synthetic oligonucleotide
acaggucuuuaccaccac

SEQ ID NO: 1518 - RNA, 18 nt, Artificial Sequence
  Description of Artificial Sequence: Synthetic oligonucleotide
auagaacaggucuuuacc

SEQ ID NO: 1519 - RNA, 18 nt, Artificial Sequence
  Description of Artificial Sequence: Synthetic oligonucleotide
cuuacauagaacaggucu

SEQ ID NO: 1520 - RNA, 18 nt, Artificial Sequence
  Description of Artificial Sequence: Synthetic oligonucleotide
gacggcuuacauagaaca

SEQ ID NO: 1521 - RNA, 18 nt, Artificial Sequence
  Description of Artificial Sequence: Synthetic oligonucleotide
ggguggacggcuuacaua

SEQ ID NO: 1522 - RNA, 18 nt, Artificial Sequence
  Description of Artificial Sequence: Synthetic oligonucleotide
gugaggaacgggccaggg

SEQ ID NO: 1523 - RNA, 18 nt, Artificial Sequence
  Description of Artificial Sequence: Synthetic oligonucleotide
ggugaggaacgggccagg

SEQ ID NO: 1524 - RNA, 18 nt, Artificial Sequence
  Description of Artificial Sequence: Synthetic oligonucleotide
augcuggugaggaacggg

SEQ ID NO: 1525 - RNA, 18 nt, Artificial Sequence
  Description of Artificial Sequence: Synthetic oligonucleotide
gcaguaugcuggugagga

SEQ ID NO: 1526 - RNA, 18 nt, Artificial Sequence
  Description of Artificial Sequence: Synthetic oligonucleotide
cucgugcaguaugcuggu

SEQ ID NO: 1527 - RNA, 18 nt, Artificial Sequence
  Description of Artificial Sequence: Synthetic oligonucleotide
agcugcucgugcaguaug

SEQ ID NO: 1528 - RNA, 18 nt, Artificial Sequence
  Description of Artificial Sequence: Synthetic oligonucleotide
guccgagcugcucgugca

SEQ ID NO: 1529 - RNA, 18 nt, Artificial Sequence
  Description of Artificial Sequence: Synthetic oligonucleotide
gugauguccgagcugcuc

SEQ ID NO: 1530 - RNA, 18 nt, Artificial Sequence
  Description of Artificial Sequence: Synthetic oligonucleotide
gcucugugauguccgagc

SEQ ID NO: 1531 - RNA, 18 nt, Artificial Sequence
  Description of Artificial Sequence: Synthetic oligonucleotide
cucuggcucugugauguc

SEQ ID NO: 1532 - RNA, 18 nt, Artificial Sequence
  Description of Artificial Sequence: Synthetic oligonucleotide
uucugcucuggcucugug

SEQ ID NO: 1533 - RNA, 18 nt, Artificial Sequence
  Description of Artificial Sequence: Synthetic oligonucleotide
gcaucuucugcucuggcu

SEQ ID NO: 1534 - RNA, 18 nt, Artificial Sequence
  Description of Artificial Sequence: Synthetic oligonucleotide
acucagcaucuucugcuc

SEQ ID NO: 1535 - RNA, 18 nt, Artificial Sequence
  Description of Artificial Sequence: Synthetic oligonucleotide
uugacacucagcaucuuc

SEQ ID NO: 1536 - RNA, 18 nt, Artificial Sequence
  Description of Artificial Sequence: Synthetic oligonucleotide
ucuuguugacacucagca

SEQ ID NO: 1537 - RNA, 18 nt, Artificial Sequence
  Description of Artificial Sequence: Synthetic oligonucleotide
cacacucuuguugacacu

SEQ ID NO: 1538 - RNA, 18 nt, Artificial Sequence
  Description of Artificial Sequence: Synthetic oligonucleotide
auggacacacucuuguug

SEQ ID NO: 1539 - RNA, 18 nt, Artificial Sequence
  Description of Artificial Sequence: Synthetic oligonucleotide
ccagcauggacacacucu

SEQ ID NO: 1540 - RNA, 18 nt, Artificial Sequence
  Description of Artificial Sequence: Synthetic oligonucleotide
uaaguccagcauggacac

SEQ ID NO: 1541 - RNA, 18 nt, Artificial Sequence
  Description of Artificial Sequence: Synthetic oligonucleotide
cccuguaaguccagcaug

SEQ ID NO: 1542 - RNA, 18 nt, Artificial Sequence
  Description of Artificial Sequence: Synthetic oligonucleotide
caucacccuguaagucca

SEQ ID NO: 1543 - RNA, 18 nt, Artificial Sequence
  Description of Artificial Sequence: Synthetic oligonucleotide
aggcccaucacccuguaa

SEQ ID NO: 1544 - RNA, 18 nt, Artificial Sequence
  Description of Artificial Sequence: Synthetic oligonucleotide
ccaccaggcccaucaccc

SEQ ID NO: 1545 - RNA, 18 nt, Artificial Sequence
  Description of Artificial Sequence: Synthetic oligonucleotide
ggcggccaccaggcccau

SEQ ID NO: 1546 - RNA, 18 nt, Artificial Sequence
  Description of Artificial Sequence: Synthetic oligonucleotide
guugaggcggccaccagg

SEQ ID NO: 1547 - RNA, 18 nt, Artificial Sequence
  Description of Artificial Sequence: Synthetic oligonucleotide
cugcuguugaggcggcca

SEQ ID NO: 1548 - RNA, 18 nt, Artificial Sequence
  Description of Artificial Sequence: Synthetic oligonucleotide
cacugcugcuguugaggc

SEQ ID NO: 1549 - RNA, 18 nt, Artificial Sequence
  Description of Artificial Sequence: Synthetic oligonucleotide
cgaaacacugcugcuguu

SEQ ID NO: 1550 - RNA, 18 nt, Artificial Sequence
  Description of Artificial Sequence: Synthetic oligonucleotide
agguucgaaacacugcug

SEQ ID NO: 1551 - RNA, 18 nt, Artificial Sequence
  Description of Artificial Sequence: Synthetic oligonucleotide
ccgccagguucgaaacac

SEQ ID NO: 1552 - RNA, 18 nt, Artificial Sequence
  Description of Artificial Sequence: Synthetic oligonucleotide
uacggccgccagguucga

SEQ ID NO: 1553 - RNA, 18 nt, Artificial Sequence
  Description of Artificial Sequence: Synthetic oligonucleotide
uccccuacggccgccagg

SEQ ID NO: 1554 - RNA, 18 nt, Artificial Sequence
  Description of Artificial Sequence: Synthetic oligonucleotide
gcagguccccuacggccg

SEQ ID NO: 1555 - RNA, 18 nt, Artificial Sequence
  Description of Artificial Sequence: Synthetic oligonucleotide
gugcagcagguccccuac

SEQ ID NO: 1556 - RNA, 18 nt, Artificial Sequence
  Description of Artificial Sequence: Synthetic oligonucleotide
cuugagugcagcaggucc

SEQ ID NO: 1557 - RNA, 18 nt, Artificial Sequence
  Description of Artificial Sequence: Synthetic oligonucleotide
ccuggcuugagugcagca

SEQ ID NO: 1558 - RNA, 18 nt, Artificial Sequence
  Description of Artificial Sequence: Synthetic oligonucleotide
cgaggccuggcuugagug

SEQ ID NO: 1559 - RNA, 18 nt, Artificial Sequence
  Description of Artificial Sequence: Synthetic oligonucleotide
gucagcgaggccuggcuu

SEQ ID NO: 1560 - RNA, 18 nt, Artificial Sequence
  Description of Artificial Sequence: Synthetic oligonucleotide
cugcugucagcgaggccu

SEQ ID NO: 1561 - RNA, 18 nt, Artificial Sequence
  Description of Artificial Sequence: Synthetic oligonucleotide
caaggcugcugucagcga

SEQ ID NO: 1562 - RNA, 18 nt, Artificial Sequence
  Description of Artificial Sequence: Synthetic oligonucleotide
agccccaaggcugcuguc

SEQ ID NO: 1563 - RNA, 18 nt, Artificial Sequence
  Description of Artificial Sequence: Synthetic oligonucleotide
gccguagccccaaggcug

SEQ ID NO: 1564 - RNA, 18 nt, Artificial Sequence
  Description of Artificial Sequence: Synthetic oligonucleotide
cgcaggccguagccccaa

SEQ ID NO: 1565 - RNA, 18 nt, Artificial Sequence
  Description of Artificial Sequence: Synthetic oligonucleotide
gcaggcgcaggccguagc

SEQ ID NO: 1566 - RNA, 18 nt, Artificial Sequence
  Description of Artificial Sequence: Synthetic oligonucleotide
guccggcaggcgcaggcc

SEQ ID NO: 1567 - RNA, 18 nt, Artificial Sequence
  Description of Artificial Sequence: Synthetic oligonucleotide
gaggcguccggcaggcgc

SEQ ID NO: 1568 - RNA, 18 nt, Artificial Sequence
  Description of Artificial Sequence: Synthetic oligonucleotide
ugggagaggcguccggca

SEQ ID NO: 1569 - RNA, 18 nt, Artificial Sequence
  Description of Artificial Sequence: Synthetic oligonucleotide
uccccugggagaggcguc

SEQ ID NO: 1570 - RNA, 18 nt, Artificial Sequence
  Description of Artificial Sequence: Synthetic oligonucleotide
gccacuccccugggagag

SEQ ID NO: 1571 - RNA, 18 nt, Artificial Sequence
  Description of Artificial Sequence: Synthetic oligonucleotide
gaugagccacuccccugg

SEQ ID NO: 1572 - RNA, 18 nt, Artificial Sequence
  Description of Artificial Sequence: Synthetic oligonucleotide
ugauggaugagccacucc

SEQ ID NO: 1573 - RNA, 18 nt, Artificial Sequence
  Description of Artificial Sequence: Synthetic oligonucleotide
cgccgugauggaugagcc

SEQ ID NO: 1574 - RNA, 18 nt, Artificial Sequence
  Description of Artificial Sequence: Synthetic oligonucleotide
ccagccgccgugauggau

SEQ ID NO: 1575 - RNA, 18 nt, Artificial Sequence
  Description of Artificial Sequence: Synthetic oligonucleotide
gcaugccagccgccguga

SEQ ID NO: 1576 - RNA, 18 nt, Artificial Sequence
  Description of Artificial Sequence: Synthetic oligonucleotide
gaggcgcaugccagccgc

SEQ ID NO: 1577 - RNA, 18 nt, Artificial Sequence
  Description of Artificial Sequence: Synthetic oligonucleotide
uggcugaggcgcaugcca

SEQ ID NO: 1578 - RNA, 18 nt, Artificial Sequence
  Description of Artificial Sequence: Synthetic oligonucleotide
ccaucuggcugaggcgca

SEQ ID NO: 1579 - RNA, 18 nt, Artificial Sequence
  Description of Artificial Sequence: Synthetic oligonucleotide
gacacccaucuggcugag

SEQ ID NO: 1580 - RNA, 18 nt, Artificial Sequence
  Description of Artificial Sequence: Synthetic oligonucleotide
guggugacacccaucugg

SEQ ID NO: 1581 - RNA, 18 nt, Artificial Sequence
  Description of Artificial Sequence: Synthetic oligonucleotide
cgucuguggugacaccca

SEQ ID NO: 1582 - RNA, 18 nt, Artificial Sequence
  Description of Artificial Sequence: Synthetic oligonucleotide
gacaccgucuguggugac

SEQ ID NO: 1583 - RNA, 18 nt, Artificial Sequence
  Description of Artificial Sequence: Synthetic oligonucleotide
gcagggacaccgucugug

SEQ ID NO: 1584 - RNA, 18 nt, Artificial Sequence
  Description of Artificial Sequence: Synthetic oligonucleotide
gcugggcagggacaccgu

SEQ ID NO: 1585 - RNA, 18 nt, Artificial Sequence
  Description of Artificial Sequence: Synthetic oligonucleotide
caguugcugggcagggac

SEQ ID NO: 1586 - RNA, 18 nt, Artificial Sequence
  Description of Artificial Sequence: Synthetic oligonucleotide
auucgcaguugcugggca

SEQ ID NO: 1587 - RNA, 18 nt, Artificial Sequence
  Description of Artificial Sequence: Synthetic oligonucleotide
gguucuggaaggagaggg

SEQ ID NO: 1588 - RNA, 18 nt, Artificial Sequence
  Description of Artificial Sequence: Synthetic oligonucleotide
gagaggguucuggaagga

SEQ ID NO: 1589 - RNA, 18 nt, Artificial Sequence
  Description of Artificial Sequence: Synthetic oligonucleotide
uggaagagaggguucugg

SEQ ID NO: 1590 - RNA, 18 nt, Artificial Sequence
  Description of Artificial Sequence: Synthetic oligonucleotide
ccauguggaagagagggu

SEQ ID NO: 1591 - RNA, 18 nt, Artificial Sequence
  Description of Artificial Sequence: Synthetic oligonucleotide
agcagccauguggaagag

SEQ ID NO: 1592 - RNA, 18 nt, Artificial Sequence
  Description of Artificial Sequence: Synthetic oligonucleotide
ccaucagcagccaugugg

SEQ ID NO: 1593 - RNA, 18 nt, Artificial Sequence
  Description of Artificial Sequence: Synthetic oligonucleotide
cuggcccaucagcagcca

SEQ ID NO: 1594 - RNA, 18 nt, Artificial Sequence
  Description of Artificial Sequence: Synthetic oligonucleotide
gggaccuggcccaucagc

SEQ ID NO: 1595 - RNA, 18 nt, Artificial Sequence
  Description of Artificial Sequence: Synthetic oligonucleotide
ccuccauggccgccuggg

SEQ ID NO: 1596 - RNA, 18 nt, Artificial Sequence
  Description of Artificial Sequence: Synthetic oligonucleotide
cccccuccauggccgccu

SEQ ID NO: 1597 - RNA, 18 nt, Artificial Sequence
  Description of Artificial Sequence: Synthetic oligonucleotide
caccgcccccuccauggc

SEQ ID NO: 1598 - RNA, 18 nt, Artificial Sequence
  Description of Artificial Sequence: Synthetic oligonucleotide
auggccaccgcccccucc

SEQ ID NO: 1599 - RNA, 18 nt, Artificial Sequence
  Description of Artificial Sequence: Synthetic oligonucleotide
gggccauggccaccgccc

SEQ ID NO: 1600 - RNA, 18 nt, Artificial Sequence
  Description of Artificial Sequence: Synthetic oligonucleotide
aaggugggccauggccac

SEQ ID NO: 1601 - RNA, 18 nt, Artificial Sequence
  Description of Artificial Sequence: Synthetic oligonucleotide
ggaggaaggugggccaug

SEQ ID NO: 1602 - RNA, 18 nt, Artificial Sequence
  Description of Artificial Sequence: Synthetic oligonucleotide
ugaugggaggaagguggg

SEQ ID NO: 1603 - RNA, 18 nt, Artificial Sequence
  Description of Artificial Sequence: Synthetic oligonucleotide
gguggugaugggaggaag

SEQ ID NO: 1604 - RNA, 18 nt, Artificial Sequence
  Description of Artificial Sequence: Synthetic oligonucleotide
guggugguggugauggga

SEQ ID NO: 1605 - RNA, 18 nt, Artificial Sequence
  Description of Artificial Sequence: Synthetic oligonucleotide
ugguggugguggugguga

SEQ ID NO: 1606 - RNA, 18 nt, Artificial Sequence
  Description of Artificial Sequence: Synthetic oligonucleotide
ggugaugguggugguggu

SEQ ID NO: 1607 - RNA, 18 nt, Artificial Sequence
  Description of Artificial Sequence: Synthetic oligonucleotide
gugguggugaugguggug

SEQ ID NO: 1608 - RNA, 18 nt, Artificial Sequence
  Description of Artificial Sequence: Synthetic oligonucleotide
ccucggugguggugaugg

SEQ ID NO: 1609 - RNA, 18 nt, Artificial Sequence
  Description of Artificial Sequence: Synthetic oligonucleotide
cuccaccucggugguggu

SEQ ID NO: 1610 - RNA, 18 nt, Artificial Sequence
  Description of Artificial Sequence: Synthetic oligonucleotide
gggcucuccaccucggug

SEQ ID NO: 1611 - RNA, 18 nt, Artificial Sequence
  Description of Artificial Sequence: Synthetic oligonucleotide
gcaaagguguccccaggg

SEQ ID NO: 1612 - RNA, 18 nt, Artificial Sequence
  Description of Artificial Sequence: Synthetic oligonucleotide
cuauagccauggaauggg

SEQ ID NO: 1613 - RNA, 18 nt, Artificial Sequence
  Description of Artificial Sequence: Synthetic oligonucleotide
ucuugcuauagccaugga

SEQ ID NO: 1614 - RNA, 18 nt, Artificial Sequence
  Description of Artificial Sequence: Synthetic oligonucleotide
cucacucuugcuauagcc

SEQ ID NO: 1615 - RNA, 18 nt, Artificial Sequence
  Description of Artificial Sequence: Synthetic oligonucleotide
agguccucacucuugcua

SEQ ID NO: 1616 - RNA, 18 nt, Artificial Sequence
  Description of Artificial Sequence: Synthetic oligonucleotide
aagagagguccucacucu

SEQ ID NO: 1617 - RNA, 18 nt, Artificial Sequence
  Description of Artificial Sequence: Synthetic oligonucleotide
cccggaagagagguccuc

SEQ ID NO: 1618 - RNA, 18 nt, Artificial Sequence
  Description of Artificial Sequence: Synthetic oligonucleotide
gggaccccggaagagagg

SEQ ID NO: 1619 - RNA, 18 nt, Artificial Sequence
  Description of Artificial Sequence: Synthetic oligonucleotide
aggauggaggcagcaggg

SEQ ID NO: 1620 - RNA, 18 nt, Artificial Sequence
  Description of Artificial Sequence: Synthetic oligonucleotide
ugaaggauggaggcagca

SEQ ID NO: 1621 - RNA, 18 nt, Artificial Sequence
  Description of Artificial Sequence: Synthetic oligonucleotide
ggcuaugaaggauggagg

SEQ ID NO: 1622 - RNA, 18 nt, Artificial Sequence
  Description of Artificial Sequence: Synthetic oligonucleotide
gcuguggcuaugaaggau

SEQ ID NO: 1623 - RNA, 18 nt, Artificial Sequence
  Description of Artificial Sequence: Synthetic oligonucleotide
cuguagcuguggcuauga

SEQ ID NO: 1624 - RNA, 18 nt, Artificial Sequence
  Description of Artificial Sequence: Synthetic oligonucleotide
caucacuguagcuguggc

SEQ ID NO: 1625 - RNA, 18 nt, Artificial Sequence
  Description of Artificial Sequence: Synthetic oligonucleotide
aaacucaucacuguagcu

SEQ ID NO: 1626 - RNA, 18 nt, Artificial Sequence
  Description of Artificial Sequence: Synthetic oligonucleotide
gguccaaacucaucacug

SEQ ID NO: 1627 - RNA, 18 nt, Artificial Sequence
  Description of Artificial Sequence: Synthetic oligonucleotide
cagaggguccaaacucau

SEQ ID NO: 1628 - RNA, 18 nt, Artificial Sequence
  Description of Artificial Sequence: Synthetic oligonucleotide
agugccagaggguccaaa

SEQ ID NO: 1629 - RNA, 18 nt, Artificial Sequence
  Description of Artificial Sequence: Synthetic oligonucleotide
aagucagugccagagggu

SEQ ID NO: 1630 - RNA, 18 nt, Artificial Sequence
  Description of Artificial Sequence: Synthetic oligonucleotide
gggugaagucagugccag

SEQ ID NO: 1631 - RNA, 18 nt, Artificial Sequence
  Description of Artificial Sequence: Synthetic oligonucleotide
ccgacgggugaagucagu

SEQ ID NO: 1632 - RNA, 18 nt, Artificial Sequence
  Description of Artificial Sequence: Synthetic oligonucleotide
agcugccgacgggugaag

SEQ ID NO: 1633 - RNA, 18 nt, Artificial Sequence
  Description of Artificial Sequence: Synthetic oligonucleotide
gugaaagcugccgacggg

SEQ ID NO: 1634 - RNA, 18 nt, Artificial Sequence
  Description of Artificial Sequence: Synthetic oligonucleotide
cuggagugaaagcugccg

SEQ ID NO: 1635 - RNA, 18 nt, Artificial Sequence
  Description of Artificial Sequence: Synthetic oligonucleotide
uuguccuggagugaaagc

SEQ ID NO: 1636 - RNA, 18 nt, Artificial Sequence
  Description of Artificial Sequence: Synthetic oligonucleotide
gcagguuguccuggagug

SEQ ID NO: 1637 - RNA, 18 nt, Artificial Sequence
  Description of Artificial Sequence: Synthetic oligonucleotide
gugcugcagguuguccug

SEQ ID NO: 1638 - RNA, 18 nt, Artificial Sequence
  Description of Artificial Sequence: Synthetic oligonucleotide
agcaugugcugcagguug

SEQ ID NO: 1639 - RNA, 18 nt, Artificial Sequence
  Description of Artificial Sequence: Synthetic oligonucleotide
gggacagcaugugcugca

SEQ ID NO: 1640 - RNA, 18 nt, Artificial Sequence
  Description of Artificial Sequence: Synthetic oligonucleotide
gaccaauggugaucuggg

SEQ ID NO: 1641 - RNA, 18 nt, Artificial Sequence
  Description of Artificial Sequence: Synthetic oligonucleotide
gggaccaauggugaucug

SEQ ID NO: 1642 - RNA, 18 nt, Artificial Sequence
  Description of Artificial Sequence: Synthetic oligonucleotide
accuccaggcccugaggg

SEQ ID NO: 1643 - RNA, 18 nt, Artificial Sequence
  Description of Artificial Sequence: Synthetic oligonucleotide
cucccaccuccaggcccu

SEQ ID NO: 1644 - RNA, 18 nt, Artificial Sequence
  Description of Artificial Sequence: Synthetic oligonucleotide
caccgcucccaccuccag

SEQ ID NO: 1645 - RNA, 18 nt, Artificial Sequence
  Description of Artificial Sequence: Synthetic oligonucleotide
gcccccaccgcucccacc

SEQ ID NO: 1646 - RNA, 18 nt, Artificial Sequence
  Description of Artificial Sequence: Synthetic oligonucleotide
ccgcugcccccaccgcuc

SEQ ID NO: 1647 - RNA, 18 nt, Artificial Sequence
  Description of Artificial Sequence: Synthetic oligonucleotide
ccccaccgcugcccccac

SEQ ID NO: 1648 - RNA, 18 nt, Artificial Sequence
  Description of Artificial Sequence: Synthetic oligonucleotide
gccacccccaccgcugcc

SEQ ID NO: 1649 - RNA, 18 nt, Artificial Sequence
  Description of Artificial Sequence: Synthetic oligonucleotide
cccccgccacccccaccg

SEQ ID NO: 1650 - RNA, 18 nt, Artificial Sequence
  Description of Artificial Sequence: Synthetic oligonucleotide
gcuggcccccgccacccc

SEQ ID NO: 1651 - RNA, 18 nt, Artificial Sequence
  Description of Artificial Sequence: Synthetic oligonucleotide
aggcggcuggcccccgcc

SEQ ID NO: 1652 - RNA, 18 nt, Artificial Sequence
  Description of Artificial Sequence: Synthetic oligonucleotide
aauggaggcggcuggccc

SEQ ID NO: 1653 - RNA, 18 nt, Artificial Sequence
  Description of Artificial Sequence: Synthetic oligonucleotide
ucugcaauggaggcggcu

SEQ ID NO: 1654 - RNA, 18 nt, Artificial Sequence
  Description of Artificial Sequence: Synthetic oligonucleotide
gccccucugcaauggagg

SEQ ID NO: 1655 - RNA, 18 nt, Artificial Sequence
  Description of Artificial Sequence: Synthetic oligonucleotide
gacuugccccucugcaau

SEQ ID NO: 1656 - RNA, 18 nt, Artificial Sequence
  Description of Artificial Sequence: Synthetic oligonucleotide
gcugagacuugccccucu

SEQ ID NO: 1657 - RNA, 18 nt, Artificial Sequence
  Description of Artificial Sequence: Synthetic oligonucleotide
caacugcugagacuugcc

SEQ ID NO: 1658 - RNA, 18 nt, Artificial Sequence
  Description of Artificial Sequence: Synthetic oligonucleotide
acugucaacugcugagac

SEQ ID NO: 1659 - RNA, 18 nt, Artificial Sequence
  Description of Artificial Sequence: Synthetic oligonucleotide
cgcugacugucaacugcu

SEQ ID NO: 1660 - RNA, 18 nt, Artificial Sequence
  Description of Artificial Sequence: Synthetic oligonucleotide
ggcugcgcugacugucaa

SEQ ID NO: 1661 - RNA, 18 nt, Artificial Sequence
  Description of Artificial Sequence: Synthetic oligonucleotide
uucugggcugcgcugacu

SEQ ID NO: 1662 - RNA, 18 nt, Artificial Sequence
  Description of Artificial Sequence: Synthetic oligonucleotide
ucccgcuggauggccggg

SEQ ID NO: 1663 - RNA, 18 nt, Artificial Sequence
  Description of Artificial Sequence: Synthetic oligonucleotide
uagauucccgcuggaugg

SEQ ID NO: 1664 - RNA, 18 nt, Artificial Sequence
  Description of Artificial Sequence: Synthetic oligonucleotide
ugcaauagauucccgcug

SEQ ID NO: 1665 - RNA, 18 nt, Artificial Sequence
  Description of Artificial Sequence: Synthetic oligonucleotide
gggacugcaauagauucc

SEQ ID NO: 1666 - RNA, 18 nt, Artificial Sequence
  Description of Artificial Sequence: Synthetic oligonucleotide
ccauaacuuggcucuggg

SEQ ID NO: 1667 - RNA, 18 nt, Artificial Sequence
  Description of Artificial Sequence: Synthetic oligonucleotide
gggccauaacuuggcucu

SEQ ID NO: 1668 - RNA, 18 nt, Artificial Sequence
  Description of Artificial Sequence: Synthetic oligonucleotide
uugccguggacgggcggg

SEQ ID NO: 1669 - RNA, 18 nt, Artificial Sequence
  Description of Artificial Sequence: Synthetic oligonucleotide
uguugccguggacgggcg

SEQ ID NO: 1670 - RNA, 18 nt, Artificial Sequence
  Description of Artificial Sequence: Synthetic oligonucleotide
ggcucuguugccguggac

SEQ ID NO: 1671 - RNA, 18 nt, Artificial Sequence
  Description of Artificial Sequence: Synthetic oligonucleotide
gcugaggcucuguugccg

SEQ ID NO: 1672 - RNA, 18 nt, Artificial Sequence
  Description of Artificial Sequence: Synthetic oligonucleotide
uccuugcugaggcucugu

SEQ ID NO: 1673 - RNA, 18 nt, Artificial Sequence
  Description of Artificial Sequence: Synthetic oligonucleotide
ugcccuccuugcugaggc

SEQ ID NO: 1674 - RNA, 18 nt, Artificial Sequence
  Description of Artificial Sequence: Synthetic oligonucleotide
aaugcugcccuccuugcu

SEQ ID NO: 1675 - RNA, 18 nt, Artificial Sequence
  Description of Artificial Sequence: Synthetic oligonucleotide
cccccaaugcugcccucc

SEQ ID NO: 1676 - RNA, 18 nt, Artificial Sequence
  Description of Artificial Sequence: Synthetic oligonucleotide
cgcugcccccaaugcugc

SEQ ID NO: 1677 - RNA, 18 nt, Artificial Sequence
  Description of Artificial Sequence: Synthetic oligonucleotide
gcccccgcugcccccaau

SEQ ID NO: 1678 - RNA, 18 nt, Artificial Sequence
  Description of Artificial Sequence: Synthetic oligonucleotide
ccgcugcccccgcugccc

SEQ ID NO: 1679 - RNA, 18 nt, Artificial Sequence
  Description of Artificial Sequence: Synthetic oligonucleotide
cgccaccgcugcccccgc

SEQ ID NO: 1680 - RNA, 18 nt, Artificial Sequence
  Description of Artificial Sequence: Synthetic oligonucleotide
cccuccgccaccgcugcc

SEQ ID NO: 1681 - RNA, 18 nt, Artificial Sequence
  Description of Artificial Sequence: Synthetic oligonucleotide
ccacccccuccgccaccg

SEQ ID NO: 1682 - RNA, 18 nt, Artificial Sequence
  Description of Artificial Sequence: Synthetic oligonucleotide
gccccccacccccuccgc

SEQ ID NO: 1683 - RNA, 18 nt, Artificial Sequence
  Description of Artificial Sequence: Synthetic oligonucleotide
cuucagccccccaccccc

SEQ ID NO: 1684 - RNA, 18 nt, Artificial Sequence
  Description of Artificial Sequence: Synthetic oligonucleotide
gagggcuucagcccccca

SEQ ID NO: 1685 - RNA, 18 nt, Artificial Sequence
  Description of Artificial Sequence: Synthetic oligonucleotide
ugauggagggcuucagcc

SEQ ID NO: 1686 - RNA, 18 nt, Artificial Sequence
  Description of Artificial Sequence: Synthetic oligonucleotide
cuuggugauggagggcuu

SEQ ID NO: 1687 - RNA, 18 nt, Artificial Sequence
  Description of Artificial Sequence: Synthetic oligonucleotide
gccuuccuccugccuuca

SEQ ID NO: 1688 - RNA, 18 nt, Artificial Sequence
  Description of Artificial Sequence: Synthetic oligonucleotide
agcccgccuuccuccugc

SEQ ID NO: 1689 - RNA, 18 nt, Artificial Sequence
  Description of Artificial Sequence: Synthetic oligonucleotide
gacccagcccgccuuccu

SEQ ID NO: 1690 - RNA, 18 nt, Artificial Sequence
  Description of Artificial Sequence: Synthetic oligonucleotide
guugugacccagcccgcc

SEQ ID NO: 1691 - RNA, 18 nt, Artificial Sequence
  Description of Artificial Sequence: Synthetic oligonucleotide
ucccuguugugacccagc

SEQ ID NO: 1692 - RNA, 18 nt, Artificial Sequence
  Description of Artificial Sequence: Synthetic oligonucleotide
uucccucccuguugugac

SEQ ID NO: 1693 - RNA, 18 nt, Artificial Sequence
  Description of Artificial Sequence: Synthetic oligonucleotide
ccuucuucccucccuguu

SEQ ID NO: 1694 - RNA, 18 nt, Artificial Sequence
  Description of Artificial Sequence: Synthetic oligonucleotide
caucuccuucuucccucc

SEQ ID NO: 1695 - RNA, 18 nt, Artificial Sequence
  Description of Artificial Sequence: Synthetic oligonucleotide
ccccccaucuccuucuuc

SEQ ID NO: 1696 - RNA, 18 nt, Artificial Sequence
  Description of Artificial Sequence: Synthetic oligonucleotide
ccccaccccccaucuccu

SEQ ID NO: 1697 - RNA, 18 nt, Artificial Sequence
  Description of Artificial Sequence: Synthetic oligonucleotide
uucaaccccaccccccau

SEQ ID NO: 1698 - RNA, 18 nt, Artificial Sequence
  Description of Artificial Sequence: Synthetic oligonucleotide
ucuguuucaaccccaccc

SEQ ID NO: 1699 - RNA, 18 nt, Artificial Sequence
  Description of Artificial Sequence: Synthetic oligonucleotide
cagacucuguuucaaccc

SEQ ID NO: 1700 - RNA, 18 nt, Artificial Sequence
  Description of Artificial Sequence: Synthetic oligonucleotide
ggccacagacucuguuuc

SEQ ID NO: 1701 - RNA, 18 nt, Artificial Sequence
  Description of Artificial Sequence: Synthetic oligonucleotide
cuucaggccacagacucu

SEQ ID NO: 1702 - RNA, 18 nt, Artificial Sequence
  Description of Artificial Sequence: Synthetic oligonucleotide
uguaacuucaggccacag

SEQ ID NO: 1703 - RNA, 18 nt, Artificial Sequence
  Description of Artificial Sequence: Synthetic oligonucleotide
aagauuguaacuucaggc

SEQ ID NO: 1704 - RNA, 18 nt, Artificial Sequence
  Description of Artificial Sequence: Synthetic oligonucleotide
gcaagaagauuguaacuu

SEQ ID NO: 1705 - RNA, 18 nt, Artificial Sequence
  Description of Artificial Sequence: Synthetic oligonucleotide
aggaggcaagaagauugu

SEQ ID NO: 1706 - RNA, 18 nt, Artificial Sequence
  Description of Artificial Sequence: Synthetic oligonucleotide
ccaaaaggaggcaagaag

SEQ ID NO: 1707 - RNA, 18 nt, Artificial Sequence
  Description of Artificial Sequence: Synthetic oligonucleotide
aauggccaaaaggaggca

SEQ ID NO: 1708 - RNA, 18 nt, Artificial Sequence
  Description of Artificial Sequence: Synthetic oligonucleotide
uguuuaauggccaaaagg

SEQ ID NO: 1709 - RNA, 18 nt, Artificial Sequence
  Description of Artificial Sequence: Synthetic oligonucleotide
acauuuguuuaauggcca

SEQ ID NO: 1710 - RNA, 18 nt, Artificial Sequence
  Description of Artificial Sequence: Synthetic oligonucleotide
uauacacauuuguuuaau

SEQ ID NO: 1711 - RNA, 18 nt, Artificial Sequence
  Description of Artificial Sequence: Synthetic oligonucleotide
cccucuauacacauuugu

SEQ ID NO: 1712 - RNA, 18 nt, Artificial Sequence
  Description of Artificial Sequence: Synthetic oligonucleotide
gcaggcccucuauacaca

SEQ ID NO: 1713 - RNA, 18 nt, Artificial Sequence
  Description of Artificial Sequence: Synthetic oligonucleotide
acauagcaggcccucuau

SEQ ID NO: 1714 - RNA, 18 nt, Artificial Sequence
  Description of Artificial Sequence: Synthetic oligonucleotide
auggcacauagcaggccc

SEQ ID NO: 1715 - RNA, 18 nt, Artificial Sequence
  Description of Artificial Sequence: Synthetic oligonucleotide
agcacauggcacauagca

SEQ ID NO: 1716 - RNA, 18 nt, Artificial Sequence
  Description of Artificial Sequence: Synthetic oligonucleotide
ggcauagcacauggcaca

SEQ ID NO: 1717 - RNA, 18 nt, Artificial Sequence
  Description of Artificial Sequence: Synthetic oligonucleotide
ugccuggcauagcacaug

SEQ ID NO: 1718 - RNA, 18 nt, Artificial Sequence
  Description of Artificial Sequence: Synthetic oligonucleotide
cuuagugccuggcauagc

SEQ ID NO: 1719 - RNA, 18 nt, Artificial Sequence
  Description of Artificial Sequence: Synthetic oligonucleotide
guauccuuagugccuggc

SEQ ID NO: 1720 - RNA, 18 nt, Artificial Sequence
  Description of Artificial Sequence: Synthetic oligonucleotide
gugccguauccuuagugc

SEQ ID NO: 1721 - RNA, 18 nt, Artificial Sequence
  Description of Artificial Sequence: Synthetic oligonucleotide
guucagugccguauccuu

SEQ ID NO: 1722 - RNA, 18 nt, Artificial Sequence
  Description of Artificial Sequence: Synthetic oligonucleotide
agaggguucagugccgua

SEQ ID NO: 1723 - RNA, 18 nt, Artificial Sequence
  Description of Artificial Sequence: Synthetic oligonucleotide
ugcuaagaggguucagug

SEQ ID NO: 1724 - RNA, 18 nt, Artificial Sequence
  Description of Artificial Sequence: Synthetic oligonucleotide
gagagugcuaagaggguu

SEQ ID NO: 1725 - RNA, 18 nt, Artificial Sequence
  Description of Artificial Sequence: Synthetic oligonucleotide
ggaaugagagugcuaaga

SEQ ID NO: 1726 - RNA, 18 nt, Artificial Sequence
  Description of Artificial Sequence: Synthetic oligonucleotide
ccucuggaaugagagugc

SEQ ID NO: 1727 - RNA, 18 nt, Artificial Sequence
  Description of Artificial Sequence: Synthetic oligonucleotide
aauccccucuggaaugag

SEQ ID NO: 1728 - RNA, 18 nt, Artificial Sequence
  Description of Artificial Sequence: Synthetic oligonucleotide
ggauuaauccccucugga

SEQ ID NO: 1729 - RNA, 18 nt, Artificial Sequence
  Description of Artificial Sequence: Synthetic oligonucleotide
cuuauggauuaauccccu

SEQ ID NO: 1730 - RNA, 18 nt, Artificial Sequence
  Description of Artificial Sequence: Synthetic oligonucleotide
uucuacuuauggauuaau

SEQ ID NO: 1731 - RNA, 18 nt, Artificial Sequence
  Description of Artificial Sequence: Synthetic oligonucleotide
ccccauucuacuuaugga

SEQ ID NO: 1732 - RNA, 18 nt, Artificial Sequence
  Description of Artificial Sequence: Synthetic oligonucleotide
gucacccccauucuacuu

SEQ ID NO: 1733 - RNA, 18 nt, Artificial Sequence
  Description of Artificial Sequence: Synthetic oligonucleotide
uuccagucacccccauuc

SEQ ID NO: 1734 - RNA, 18 nt, Artificial Sequence
  Description of Artificial Sequence: Synthetic oligonucleotide
cccuauuccagucacccc

SEQ ID NO: 1735 - RNA, 18 nt, Artificial Sequence
  Description of Artificial Sequence: Synthetic oligonucleotide
gcuggcccuauuccaguc

SEQ ID NO: 1736 - RNA, 18 nt, Artificial Sequence
  Description of Artificial Sequence: Synthetic oligonucleotide
ccccagcuggcccuauuc

SEQ ID NO: 1737 - RNA, 18 nt, Artificial Sequence
  Description of Artificial Sequence: Synthetic oligonucleotide
ggauuaauccccucugga

SEQ ID NO: 1738 - RNA, 18 nt, Artificial Sequence
  Description of Artificial Sequence: Synthetic oligonucleotide
cuuauggauuaauccccu

SEQ ID NO: 1739 - RNA, 18 nt, Artificial Sequence
  Description of Artificial Sequence: Synthetic oligonucleotide
uucuacuuauggauuaau

SEQ ID NO: 1740 - RNA, 18 nt, Artificial Sequence
  Description of Artificial Sequence: Synthetic oligonucleotide
ccccauucuacuuaugga

SEQ ID NO: 1741 - RNA, 18 nt, Artificial Sequence
  Description of Artificial Sequence: Synthetic oligonucleotide
gucacccccauucuacuu

SEQ ID NO: 1742 - RNA, 18 nt, Artificial Sequence
  Description of Artificial Sequence: Synthetic oligonucleotide
uuccagucacccccauuc

SEQ ID NO: 1743 - RNA, 18 nt, Artificial Sequence
  Description of Artificial Sequence: Synthetic oligonucleotide
cccuauuccagucacccc

SEQ ID NO: 1744 - RNA, 18 nt, Artificial Sequence
  Description of Artificial Sequence: Synthetic oligonucleotide
gcuggcccuauuccaguc

SEQ ID NO: 1745 - RNA, 18 nt, Artificial Sequence
  Description of Artificial Sequence: Synthetic oligonucleotide
ccccagcuggcccuauuc

SEQ ID NO: 1746 - RNA, 18 nt, Artificial Sequence
  Description of Artificial Sequence: Synthetic oligonucleotide
caagcccccagcuggccc

SEQ ID NO: 1747 - RNA, 18 nt, Artificial Sequence
  Description of Artificial Sequence: Synthetic oligonucleotide
gccuccaagcccccagcu

SEQ ID NO: 1748 - RNA, 18 nt, Artificial Sequence
  Description of Artificial Sequence: Synthetic oligonucleotide
uucaugccuccaagcccc

SEQ ID NO: 1749 - RNA, 18 nt, Artificial Sequence
  Description of Artificial Sequence: Synthetic oligonucleotide
ugaucuucaugccuccaa

SEQ ID NO: 1750 - RNA, 18 nt, Artificial Sequence
  Description of Artificial Sequence: Synthetic oligonucleotide
ggaucugaucuucaugcc

SEQ ID NO: 1751 - RNA, 18 nt, Artificial Sequence
  Description of Artificial Sequence: Synthetic oligonucleotide
auucaggaucugaucuuc

SEQ ID NO: 1752 - RNA, 18 nt, Artificial Sequence
  Description of Artificial Sequence: Synthetic oligonucleotide
uucugauucaggaucuga

SEQ ID NO: 1753 - RNA, 18 nt, Artificial Sequence
  Description of Artificial Sequence: Synthetic oligonucleotide
uguuguucugauucagga

SEQ ID NO: 1754 - RNA, 18 nt, Artificial Sequence
  Description of Artificial Sequence: Synthetic oligonucleotide
ucuccuguuguucugauu

SEQ ID NO: 1755 - RNA, 18 nt, Artificial Sequence
  Description of Artificial Sequence: Synthetic oligonucleotide
gaauuucuccuguuguuc

SEQ ID NO: 1756 - RNA, 18 nt, Artificial Sequence
  Description of Artificial Sequence: Synthetic oligonucleotide
ccagagaauuucuccugu

SEQ ID NO: 1757 - RNA, 18 nt, Artificial Sequence
  Description of Artificial Sequence: Synthetic oligonucleotide
gaaugccagagaauuucu

SEQ ID NO: 1758 - RNA, 18 nt, Artificial Sequence
  Description of Artificial Sequence: Synthetic oligonucleotide
gaguugaaugccagagaa

SEQ ID NO: 1759 - RNA, 18 nt, Artificial Sequence
  Description of Artificial Sequence: Synthetic oligonucleotide
gaugugaguugaaugcca

SEQ ID NO: 1760 - RNA, 18 nt, Artificial Sequence
  Description of Artificial Sequence: Synthetic oligonucleotide
ccagagaugugaguugaa

SEQ ID NO: 1761 - RNA, 18 nt, Artificial Sequence
  Description of Artificial Sequence: Synthetic oligonucleotide
gaaugccagagaugugag

SEQ ID NO: 1762 - RNA, 18 nt, Artificial Sequence
  Description of Artificial Sequence: Synthetic oligonucleotide
ccucugaaugccagagau

SEQ ID NO: 1763 - RNA, 18 nt, Artificial Sequence
  Description of Artificial Sequence: Synthetic oligonucleotide
uaucaccucugaaugcca

SEQ ID NO: 1764 - RNA, 18 nt, Artificial Sequence
  Description of Artificial Sequence: Synthetic oligonucleotide
gccuuuaucaccucugaa

SEQ ID NO: 1765 - RNA, 18 nt, Artificial Sequence
  Description of Artificial Sequence: Synthetic oligonucleotide
cuguagccuuuaucaccu

SEQ ID NO: 1766 - RNA, 18 nt, Artificial Sequence
  Description of Artificial Sequence: Synthetic oligonucleotide
cccugcuguagccuuuau

SEQ ID NO: 1767 - RNA, 18 nt, Artificial Sequence
  Description of Artificial Sequence: Synthetic oligonucleotide
uauugcccugcuguagcc

SEQ ID NO: 1768 - RNA, 18 nt, Artificial Sequence
  Description of Artificial Sequence: Synthetic oligonucleotide
aguccuauugcccugcug

SEQ ID NO: 1769 - RNA, 18 nt, Artificial Sequence
  Description of Artificial Sequence: Synthetic oligonucleotide
gucccaguccuauugccc

SEQ ID NO: 1770 - RNA, 18 nt, Artificial Sequence
  Description of Artificial Sequence: Synthetic oligonucleotide
cgacagucccaguccuau

SEQ ID NO: 1771 - RNA, 18 nt, Artificial Sequence
  Description of Artificial Sequence: Synthetic oligonucleotide
ggagacgacagucccagu

SEQ ID NO: 1772 - RNA, 18 nt, Artificial Sequence
  Description of Artificial Sequence: Synthetic oligonucleotide
ccaaaggagacgacaguc

SEQ ID NO: 1773 - RNA, 18 nt, Artificial Sequence
  Description of Artificial Sequence: Synthetic oligonucleotide
cacagccaaaggagacga

SEQ ID NO: 1774 - RNA, 18 nt, Artificial Sequence
  Description of Artificial Sequence: Synthetic oligonucleotide
aacagcacagccaaagga

SEQ ID NO: 1775 - RNA, 18 nt, Artificial Sequence
  Description of Artificial Sequence: Synthetic oligonucleotide
agggcaacagcacagcca

SEQ ID NO: 1776 - RNA, 18 nt, Artificial Sequence
  Description of Artificial Sequence: Synthetic oligonucleotide
uuuagagggcaacagcac

SEQ ID NO: 1777 - RNA, 18 nt, Artificial Sequence
  Description of Artificial Sequence: Synthetic oligonucleotide
guacauuuagagggcaac

SEQ ID NO: 1778 - RNA, 18 nt, Artificial Sequence
  Description of Artificial Sequence: Synthetic oligonucleotide
gcaggguacauuuagagg

SEQ ID NO: 1779 - RNA, 18 nt, Artificial Sequence
  Description of Artificial Sequence: Synthetic oligonucleotide
aaaaagcaggguacauuu

SEQ ID NO: 1780 - RNA, 18 nt, Artificial Sequence
  Description of Artificial Sequence: Synthetic oligonucleotide
gugggaaaaagcagggua

SEQ ID NO: 1781 - RNA, 18 nt, Artificial Sequence
  Description of Artificial Sequence: Synthetic oligonucleotide
aaaaggugggaaaaagca

SEQ ID NO: 1782 - RNA, 18 nt, Artificial Sequence
  Description of Artificial Sequence: Synthetic oligonucleotide
gaaagaaaaggugggaaa

SEQ ID NO: 1783 - RNA, 18 nt, Artificial Sequence
  Description of Artificial Sequence: Synthetic oligonucleotide
acagagaaagaaaaggug

SEQ ID NO: 1784 - RNA, 18 nt, Artificial Sequence
  Description of Artificial Sequence: Synthetic oligonucleotide
ggcgaacagagaaagaaa

SEQ ID NO: 1785 - RNA, 18 nt, Artificial Sequence
  Description of Artificial Sequence: Synthetic oligonucleotide
gugagggcgaacagagaa

SEQ ID NO: 1786 - RNA, 18 nt, Artificial Sequence
  Description of Artificial Sequence: Synthetic oligonucleotide
uggauggugucugagaau

SEQ ID NO: 1787 - RNA, 18 nt, Artificial Sequence
  Description of Artificial Sequence: Synthetic oligonucleotide
caauguggauggugucug

SEQ ID NO: 1788 - RNA, 18 nt, Artificial Sequence
  Description of Artificial Sequence: Synthetic oligonucleotide
ggguucaauguggauggu

SEQ ID NO: 1789 - RNA, 18 nt, Artificial Sequence
  Description of Artificial Sequence: Synthetic oligonucleotide
gcucagaggcuggcauug

SEQ ID NO: 1790 - RNA, 18 nt, Artificial Sequence
  Description of Artificial Sequence: Synthetic oligonucleotide
uguccgcucagaggcugg

SEQ ID NO: 1791 - RNA, 18 nt, Artificial Sequence
  Description of Artificial Sequence: Synthetic oligonucleotide
gccacuguccgcucagag

SEQ ID NO: 1792 - RNA, 18 nt, Artificial Sequence
  Description of Artificial Sequence: Synthetic oligonucleotide
cccaggccacuguccgcu

SEQ ID NO: 1793 - RNA, 18 nt, Artificial Sequence
  Description of Artificial Sequence: Synthetic oligonucleotide
ggagacccaggccacugu

SEQ ID NO: 1794 - RNA, 18 nt, Artificial Sequence
  Description of Artificial Sequence: Synthetic oligonucleotide
auguuggagacccaggcc

SEQ ID NO: 1795 - RNA, 18 nt, Artificial Sequence
  Description of Artificial Sequence: Synthetic oligonucleotide
gaggcauguuggagaccc

SEQ ID NO: 1796 - RNA, 18 nt, Artificial Sequence
  Description of Artificial Sequence: Synthetic oligonucleotide
caggugaggcauguugga

SEQ ID NO: 1797 - RNA, 18 nt, Artificial Sequence
  Description of Artificial Sequence: Synthetic oligonucleotide
gccgacaggugaggcaug

SEQ ID NO: 1798 - RNA, 18 nt, Artificial Sequence
  Description of Artificial Sequence: Synthetic oligonucleotide
ugucagccgacaggugag

SEQ ID NO: 1799 - RNA, 18 nt, Artificial Sequence
  Description of Artificial Sequence: Synthetic oligonucleotide
cucgaugucagccgacag

SEQ ID NO: 1800 - RNA, 18 nt, Artificial Sequence
  Description of Artificial Sequence: Synthetic oligonucleotide
gcacucucgaugucagcc

SEQ ID NO: 1801 - RNA, 18 nt, Artificial Sequence
  Description of Artificial Sequence: Synthetic oligonucleotide
ugugggcacucucgaugu

SEQ ID NO: 1802 - RNA, 18 nt, Artificial Sequence
  Description of Artificial Sequence: Synthetic oligonucleotide
cucgaugugggcacucuc

SEQ ID NO: 1803 - RNA, 18 nt, Artificial Sequence
  Description of Artificial Sequence: Synthetic oligonucleotide
ucccgcucgaugugggca

SEQ ID NO: 1804 - RNA, 18 nt, Artificial Sequence
  Description of Artificial Sequence: Synthetic oligonucleotide
acucuucccgcucgaugu

SEQ ID NO: 1805 - RNA, 18 nt, Artificial Sequence
  Description of Artificial Sequence: Synthetic oligonucleotide
cuuguacucuucccgcuc

SEQ ID NO: 1806 - RNA, 18 nt, Artificial Sequence
  Description of Artificial Sequence: Synthetic oligonucleotide
uugagcuuguacucuucc

SEQ ID NO: 1807 - RNA, 18 nt, Artificial Sequence
  Description of Artificial Sequence: Synthetic oligonucleotide
acuccuugagcuuguacu

SEQ ID NO: 1808 - RNA, 18 nt, Artificial Sequence
  Description of Artificial Sequence: Synthetic oligonucleotide
ugaguacuccuugagcuu

SEQ ID NO: 1809 - RNA, 18 nt, Artificial Sequence
  Description of Artificial Sequence: Synthetic oligonucleotide
gauuuugaguacuccuug

SEQ ID NO: 1810 - RNA, 18 nt, Artificial Sequence
  Description of Artificial Sequence: Synthetic oligonucleotide
ccaucgauuuugaguacu

SEQ ID NO: 1811 - RNA, 18 nt, Artificial Sequence
  Description of Artificial Sequence: Synthetic oligonucleotide
cucauccaucgauuuuga

SEQ ID NO: 1812 - RNA, 18 nt, Artificial Sequence
  Description of Artificial Sequence: Synthetic oligonucleotide
cggcucucauccaucgau

SEQ ID NO: 1813 - RNA, 18 nt, Artificial Sequence
  Description of Artificial Sequence: Synthetic oligonucleotide
ccagccggcucucaucca

SEQ ID NO: 1814 - RNA, 18 nt, Artificial Sequence
  Description of Artificial Sequence: Synthetic oligonucleotide
ccuauccagccggcucuc

SEQ ID NO: 1815 - RNA, 18 nt, Artificial Sequence
  Description of Artificial Sequence: Synthetic oligonucleotide
cuccuccaccagcaucag

SEQ ID NO: 1816 - RNA, 18 nt, Artificial Sequence
  Description of Artificial Sequence: Synthetic oligonucleotide
agcuccuccuccaccagc

SEQ ID NO: 1817 - RNA, 18 nt, Artificial Sequence
  Description of Artificial Sequence: Synthetic oligonucleotide
ggcgcagcuccuccucca

SEQ ID NO: 1818 - RNA, 18 nt, Artificial Sequence
  Description of Artificial Sequence: Synthetic oligonucleotide
gucccggcgcagcuccuc

SEQ ID NO: 1819 - RNA, 18 nt, Artificial Sequence
  Description of Artificial Sequence: Synthetic oligonucleotide
ggguggucccggcgcagc

SEQ ID NO: 1820 - RNA, 18 nt, Artificial Sequence
  Description of Artificial Sequence: Synthetic oligonucleotide
cggcucagccauggcggg

SEQ ID NO: 1821 - RNA, 18 nt, Artificial Sequence
  Description of Artificial Sequence: Synthetic oligonucleotide
cagcggcucagccauggc

SEQ ID NO: 1822 - RNA, 18 nt, Artificial Sequence
  Description of Artificial Sequence: Synthetic oligonucleotide
ucuggcagcggcucagcc

SEQ ID NO: 1823 - RNA, 18 nt, Artificial Sequence
  Description of Artificial Sequence: Synthetic oligonucleotide
uggguucuggcagcggcu

SEQ ID NO: 1824 - RNA, 18 nt, Artificial Sequence
  Description of Artificial Sequence: Synthetic oligonucleotide
cuucuuggguucuggcag

SEQ ID NO: 1825 - RNA, 18 nt, Artificial Sequence
  Description of Artificial Sequence: Synthetic oligonucleotide
agccucuucuuggguucu

SEQ ID NO: 1826 - RNA, 18 nt, Artificial Sequence
  Description of Artificial Sequence: Synthetic oligonucleotide
cgagcagccucuucuugg

SEQ ID NO: 1827 - RNA, 18 nt, Artificial Sequence
  Description of Artificial Sequence: Synthetic oligonucleotide
agcgucgagcagccucuu

SEQ ID NO: 1828 - RNA, 18 nt, Artificial Sequence
  Description of Artificial Sequence: Synthetic oligonucleotide
auaaaugacauuguaauu

SEQ ID NO: 1829 - RNA, 18 nt, Artificial Sequence
  Description of Artificial Sequence: Synthetic oligonucleotide
agaagauaaaugacauug

SEQ ID NO: 1830 - RNA, 18 nt, Artificial Sequence
  Description of Artificial Sequence: Synthetic oligonucleotide
cacggagaagauaaauga

SEQ ID NO: 1831 - RNA, 18 nt, Artificial Sequence
  Description of Artificial Sequence: Synthetic oligonucleotide
ugggacacggagaagaua

SEQ ID NO: 1832 - RNA, 18 nt, Artificial Sequence
  Description of Artificial Sequence: Synthetic oligonucleotide
gggaugggacacggagaa

SEQ ID NO: 1833 - RNA, 18 nt, Artificial Sequence
  Description of Artificial Sequence: Synthetic oligonucleotide
gacagugggauggauggg

SEQ ID NO: 1834 - RNA, 18 nt, Artificial Sequence
  Description of Artificial Sequence: Synthetic oligonucleotide
cgaaagacagugggaugg

SEQ ID NO: 1835 - RNA, 18 nt, Artificial Sequence
  Description of Artificial Sequence: Synthetic oligonucleotide
gugcacgaaagacagugg

SEQ ID NO: 1836 - RNA, 18 nt, Artificial Sequence
  Description of Artificial Sequence: Synthetic oligonucleotide
agugagugcacgaaagac

SEQ ID NO: 1837 - RNA, 18 nt, Artificial Sequence
  Description of Artificial Sequence: Synthetic oligonucleotide
gguguagugagugcacga

SEQ ID NO: 1838 - RNA, 18 nt, Artificial Sequence
  Description of Artificial Sequence: Synthetic oligonucleotide
uggcugguguagugagug

SEQ ID NO: 1839 - RNA, 18 nt, Artificial Sequence
  Description of Artificial Sequence: Synthetic oligonucleotide
cuagguggcugguguagu

SEQ ID NO: 1840 - RNA, 18 nt, Artificial Sequence
  Description of Artificial Sequence: Synthetic oligonucleotide
gggcuagguggcuggugu

SEQ ID NO: 1841 - RNA, 18 nt, Artificial Sequence
  Description of Artificial Sequence: Synthetic oligonucleotide
gagacagauggugauggg

SEQ ID NO: 1842 - RNA, 18 nt, Artificial Sequence
  Description of Artificial Sequence: Synthetic oligonucleotide
uaugagagacagauggug

SEQ ID NO: 1843 - RNA, 18 nt, Artificial Sequence
  Description of Artificial Sequence: Synthetic oligonucleotide
cagacuaugagagacaga

SEQ ID NO: 1844 - RNA, 18 nt, Artificial Sequence
  Description of Artificial Sequence: Synthetic oligonucleotide
aacagcagacuaugagag

SEQ ID NO: 1845 - RNA, 18 nt, Artificial Sequence
  Description of Artificial Sequence: Synthetic oligonucleotide
ggacaaacagcagacuau

SEQ ID NO: 1846 - RNA, 18 nt, Artificial Sequence
  Description of Artificial Sequence: Synthetic oligonucleotide
ccaguggacaaacagcag

SEQ ID NO: 1847 - RNA, 18 nt, Artificial Sequence
  Description of Artificial Sequence: Synthetic oligonucleotide
agcagccaguggacaaac

SEQ ID NO: 1848 - RNA, 18 nt, Artificial Sequence
  Description of Artificial Sequence: Synthetic oligonucleotide
ccaggagcagccagugga

SEQ ID NO: 1849 - RNA, 18 nt, Artificial Sequence
  Description of Artificial Sequence: Synthetic oligonucleotide
ggcugccaggagcagcca

SEQ ID NO: 1850 - RNA, 18 nt, Artificial Sequence
  Description of Artificial Sequence: Synthetic oligonucleotide
gggcugccaggagcagcc

SEQ ID NO: 1851 - RNA, 18 nt, Artificial Sequence
  Description of Artificial Sequence: Synthetic oligonucleotide
cgaugggaugaagauggg

SEQ ID NO: 1852 - RNA, 18 nt, Artificial Sequence
  Description of Artificial Sequence: Synthetic oligonucleotide
acagacgaugggaugaag

SEQ ID NO: 1853 - RNA, 18 nt, Artificial Sequence
  Description of Artificial Sequence: Synthetic oligonucleotide
aaggcacagacgauggga

SEQ ID NO: 1854 - RNA, 18 nt, Artificial Sequence
  Description of Artificial Sequence: Synthetic oligonucleotide
ugacaaaggcacagacga

SEQ ID NO: 1855 - RNA, 18 nt, Artificial Sequence
  Description of Artificial Sequence: Synthetic oligonucleotide
aggagugacaaaggcaca

SEQ ID NO: 1856 - RNA, 18 nt, Artificial Sequence
  Description of Artificial Sequence: Synthetic oligonucleotide
cugccaggagugacaaag

SEQ ID NO: 1857 - RNA, 18 nt, Artificial Sequence
  Description of Artificial Sequence: Synthetic oligonucleotide
ugacgcugccaggaguga

SEQ ID NO: 1858 - RNA, 18 nt, Artificial Sequence
  Description of Artificial Sequence: Synthetic oligonucleotide
ugggcugacgcugccagg

SEQ ID NO: 1859 - RNA, 18 nt, Artificial Sequence
  Description of Artificial Sequence: Synthetic oligonucleotide
ggaguugggcugacgcug

SEQ ID NO: 1860 - RNA, 18 nt, Artificial Sequence
  Description of Artificial Sequence: Synthetic oligonucleotide
gcacaggaguugggcuga

SEQ ID NO: 1861 - RNA, 18 nt, Artificial Sequence
  Description of Artificial Sequence: Synthetic oligonucleotide
ggaaggcacaggaguugg

SEQ ID NO: 1862 - RNA, 18 nt, Artificial Sequence
  Description of Artificial Sequence: Synthetic oligonucleotide
ggaugggaaggcacagga

SEQ ID NO: 1863 - RNA, 18 nt, Artificial Sequence
  Description of Artificial Sequence: Synthetic oligonucleotide
agacuggaugggaaggca

SEQ ID NO: 1864 - RNA, 18 nt, Artificial Sequence
  Description of Artificial Sequence: Synthetic oligonucleotide
ugggaagacuggauggga

SEQ ID NO: 1865 - RNA, 18 nt, Artificial Sequence
  Description of Artificial Sequence: Synthetic oligonucleotide
aggagugggaagacugga

SEQ ID NO: 1866 - RNA, 18 nt, Artificial Sequence
  Description of Artificial Sequence: Synthetic oligonucleotide
cagagaggagugggaaga

SEQ ID NO: 1867 - RNA, 18 nt, Artificial Sequence
  Description of Artificial Sequence: Synthetic oligonucleotide
agaugcagagaggagugg

SEQ ID NO: 1868 - RNA, 18 nt, Artificial Sequence
  Description of Artificial Sequence: Synthetic oligonucleotide
uccugagaugcagagagg

SEQ ID NO: 1869 - RNA, 18 nt, Artificial Sequence
  Description of Artificial Sequence: Synthetic oligonucleotide
gaagguccugagaugcag

SEQ ID NO: 1870 - RNA, 18 nt, Artificial Sequence
  Description of Artificial Sequence: Synthetic oligonucleotide
guagagaagguccugaga

SEQ ID NO: 1871 - RNA, 18 nt, Artificial Sequence
  Description of Artificial Sequence: Synthetic oligonucleotide
uucugguagagaaggucc

SEQ ID NO: 1872 - RNA, 18 nt, Artificial Sequence
  Description of Artificial Sequence: Synthetic oligonucleotide
caagguucugguagagaa

SEQ ID NO: 1873 - RNA, 18 nt, Artificial Sequence
  Description of Artificial Sequence: Synthetic oligonucleotide
aagaccaagguucuggua

SEQ ID NO: 1874 - RNA, 18 nt, Artificial Sequence
  Description of Artificial Sequence: Synthetic oligonucleotide
gcagaaagaccaagguuc

SEQ ID NO: 1875 - RNA, 18 nt, Artificial Sequence
  Description of Artificial Sequence: Synthetic oligonucleotide
gggcagaaagaccaaggu

SEQ ID NO: 1876 - RNA, 18 nt, Artificial Sequence
  Description of Artificial Sequence: Synthetic oligonucleotide
uucuuggaacuagguggg

SEQ ID NO: 1877 - RNA, 18 nt, Artificial Sequence
  Description of Artificial Sequence: Synthetic oligonucleotide
ggguucuuggaacuaggu

SEQ ID NO: 1878 - RNA, 18 nt, Artificial Sequence
  Description of Artificial Sequence: Synthetic oligonucleotide
ggagugagcaaagaaggg

SEQ ID NO: 1879 - RNA, 18 nt, Artificial Sequence
  Description of Artificial Sequence: Synthetic oligonucleotide
gaauaggagugagcaaag

SEQ ID NO: 1880 - RNA, 18 nt, Artificial Sequence
  Description of Artificial Sequence: Synthetic oligonucleotide
ggcuugaauaggagugag

SEQ ID NO: 1881 - RNA, 18 nt, Artificial Sequence
  Description of Artificial Sequence: Synthetic oligonucleotide
aacguggcuugaauagga

SEQ ID NO: 1882 - RNA, 18 nt, Artificial Sequence
  Description of Artificial Sequence: Synthetic oligonucleotide
ugaacaacguggcuugaa

SEQ ID NO: 1883 - RNA, 18 nt, Artificial Sequence
  Description of Artificial Sequence: Synthetic oligonucleotide
gaagcugaacaacguggc

SEQ ID NO: 1884 - RNA, 18 nt, Artificial Sequence
  Description of Artificial Sequence: Synthetic oligonucleotide
cagaggaagcugaacaac

SEQ ID NO: 1885 - RNA, 18 nt, Artificial Sequence
  Description of Artificial Sequence: Synthetic oligonucleotide
gagcgcagaggaagcuga

SEQ ID NO: 1886 - RNA, 18 nt, Artificial Sequence
  Description of Artificial Sequence: Synthetic oligonucleotide
cccaagagcgcagaggaa

SEQ ID NO: 1887 - RNA, 18 nt, Artificial Sequence
  Description of Artificial Sequence: Synthetic oligonucleotide
ucuggcccaagagcgcag

SEQ ID NO: 1888 - RNA, 18 nt, Artificial Sequence
  Description of Artificial Sequence: Synthetic oligonucleotide
agcccucuggcccaagag

SEQ ID NO: 1889 - RNA, 18 nt, Artificial Sequence
  Description of Artificial Sequence: Synthetic oligonucleotide
cuucuagcccucuggccc

SEQ ID NO: 1890 - RNA, 18 nt, Artificial Sequence
  Description of Artificial Sequence: Synthetic oligonucleotide
agcagcuucuagcccucu

SEQ ID NO: 1891 - RNA, 18 nt, Artificial Sequence
  Description of Artificial Sequence: Synthetic oligonucleotide
aaaacagcagcuucuagc

SEQ ID NO: 1892 - RNA, 18 nt, Artificial Sequence
  Description of Artificial Sequence: Synthetic oligonucleotide
uccagaaaacagcagcuu

SEQ ID NO: 1893 - RNA, 18 nt, Artificial Sequence
  Description of Artificial Sequence: Synthetic oligonucleotide
ucuauuccagaaaacagc

SEQ ID NO: 1894 - RNA, 18 nt, Artificial Sequence
  Description of Artificial Sequence: Synthetic oligonucleotide
ugugcucuauuccagaaa

SEQ ID NO: 1895 - RNA, 18 nt, Artificial Sequence
  Description of Artificial Sequence: Synthetic oligonucleotide
ugcccugugcucuauucc

SEQ ID NO: 1896 - RNA, 18 nt, Artificial Sequence
  Description of Artificial Sequence: Synthetic oligonucleotide
cauacugcccugugcucu

SEQ ID NO: 1897 - RNA, 18 nt, Artificial Sequence
  Description of Artificial Sequence: Synthetic oligonucleotide
cagaucauacugcccugu

SEQ ID NO: 1898 - RNA, 18 nt, Artificial Sequence
  Description of Artificial Sequence: Synthetic oligonucleotide
aacuacagaucauacugc

SEQ ID NO: 1899 - RNA, 18 nt, Artificial Sequence
  Description of Artificial Sequence: Synthetic oligonucleotide
ggagaaacuacagaucau

SEQ ID NO: 1900 - RNA, 18 nt, Artificial Sequence
  Description of Artificial Sequence: Synthetic oligonucleotide
ggccuggagaaacuacag

SEQ ID NO: 1901 - RNA, 18 nt, Artificial Sequence
  Description of Artificial Sequence: Synthetic oligonucleotide
gccagggccuggagaaac

SEQ ID NO: 1902 - RNA, 18 nt, Artificial Sequence
  Description of Artificial Sequence: Synthetic oligonucleotide
uaccggccagggccugga

SEQ ID NO: 1903 - RNA, 18 nt, Artificial Sequence
  Description of Artificial Sequence: Synthetic oligonucleotide
caggguaccggccagggc

SEQ ID NO: 1904 - RNA, 18 nt, Artificial Sequence
  Description of Artificial Sequence: Synthetic oligonucleotide
guuuucaggguaccggcc

SEQ ID NO: 1905 - RNA, 18 nt, Artificial Sequence
  Description of Artificial Sequence: Synthetic oligonucleotide
cccaaguuuucaggguac

SEQ ID NO: 1906 - RNA, 18 nt, Artificial Sequence
  Description of Artificial Sequence: Synthetic oligonucleotide
ggguccccaaguuuucag

SEQ ID NO: 1907 - RNA, 18 nt, Artificial Sequence
  Description of Artificial Sequence: Synthetic oligonucleotide
gugauggguccccaaguu

SEQ ID NO: 1908 - RNA, 18 nt, Artificial Sequence
  Description of Artificial Sequence: Synthetic oligonucleotide
cagaggugaugggucccc

SEQ ID NO: 1909 - RNA, 18 nt, Artificial Sequence
  Description of Artificial Sequence: Synthetic oligonucleotide
gagaacagaggugauggg

SEQ ID NO: 1910 - RNA, 18 nt, Artificial Sequence
  Description of Artificial Sequence: Synthetic oligonucleotide
gccaagagaacagaggug

SEQ ID NO: 1911 - RNA, 18 nt, Artificial Sequence
  Description of Artificial Sequence: Synthetic oligonucleotide
agggagccaagagaacag

SEQ ID NO: 1912 - RNA, 18 nt, Artificial Sequence
  Description of Artificial Sequence: Synthetic oligonucleotide
aaauuagggagccaagag

SEQ ID NO: 1913 - RNA, 18 nt, Artificial Sequence
  Description of Artificial Sequence: Synthetic oligonucleotide
caggaaaauuagggagcc

SEQ ID NO: 1914 - RNA, 18 nt, Artificial Sequence
  Description of Artificial Sequence: Synthetic oligonucleotide
aaaacugagcuugcauuu

SEQ ID NO: 1915 - RNA, 18 nt, Artificial Sequence
  Description of Artificial Sequence: Synthetic oligonucleotide
gaagaaaaacugagcuug

SEQ ID NO: 1916 - RNA, 18 nt, Artificial Sequence
  Description of Artificial Sequence: Synthetic oligonucleotide
aaucugaagaaaaacuga

SEQ ID NO: 1917 - RNA, 18 nt, Artificial Sequence
  Description of Artificial Sequence: Synthetic oligonucleotide
uucauaaucugaagaaaa

SEQ ID NO: 1918 - RNA, 18 nt, Artificial Sequence
  Description of Artificial Sequence: Synthetic oligonucleotide
auuucuucauaaucugaa

SEQ ID NO: 1919 - RNA, 18 nt, Artificial Sequence
  Description of Artificial Sequence: Synthetic oligonucleotide
uuggaauuucuucauaau

SEQ ID NO: 1920 - RNA, 18 nt, Artificial Sequence
  Description of Artificial Sequence: Synthetic oligonucleotide
uggauuuggaauuucuuc

SEQ ID NO: 1921 - RNA, 18 nt, Artificial Sequence
  Description of Artificial Sequence: Synthetic oligonucleotide
cccuguggauuuggaauu

SEQ ID NO: 1922 - RNA, 18 nt, Artificial Sequence
  Description of Artificial Sequence: Synthetic oligonucleotide
caaaccccuguggauuug

SEQ ID NO: 1923 - RNA, 18 nt, Artificial Sequence
  Description of Artificial Sequence: Synthetic oligonucleotide
uaauccaaaccccugugg

SEQ ID NO: 1924 - RNA, 18 nt, Artificial Sequence
  Description of Artificial Sequence: Synthetic oligonucleotide
cucauuaauccaaacccc

SEQ ID NO: 1925 - RNA, 18 nt, Artificial Sequence
  Description of Artificial Sequence: Synthetic oligonucleotide
aaaaccucauuaauccaa

SEQ ID NO: 1926 - RNA, 18 nt, Artificial Sequence
  Description of Artificial Sequence: Synthetic oligonucleotide
acagcaaaaccucauuaa

SEQ ID NO: 1927 - RNA, 18 nt, Artificial Sequence
  Description of Artificial Sequence: Synthetic oligonucleotide
gcaguacagcaaaaccuc

SEQ ID NO: 1928 - RNA, 18 nt, Artificial Sequence
  Description of Artificial Sequence: Synthetic oligonucleotide
gggaggcaguacagcaaa

SEQ ID NO: 1929 - RNA, 18 nt, Artificial Sequence
  Description of Artificial Sequence: Synthetic oligonucleotide
cauguugaggaauaaggg

SEQ ID NO: 1930 - RNA, 18 nt, Artificial Sequence
  Description of Artificial Sequence: Synthetic oligonucleotide
uucauguugaggaauaag

SEQ ID NO: 1931 - RNA, 18 nt, Artificial Sequence
  Description of Artificial Sequence: Synthetic oligonucleotide
ggaacuucauguugagga

SEQ ID NO: 1932 - RNA, 18 nt, Artificial Sequence
  Description of Artificial Sequence: Synthetic oligonucleotide
aggugggaacuucauguu

SEQ ID NO: 1933 - RNA, 18 nt, Artificial Sequence
  Description of Artificial Sequence: Synthetic oligonucleotide
auccgaggugggaacuuc

SEQ ID NO: 1934 - RNA, 18 nt, Artificial Sequence
  Description of Artificial Sequence: Synthetic oligonucleotide
ccccaauccgagguggga

SEQ ID NO: 1935 - RNA, 18 nt, Artificial Sequence
  Description of Artificial Sequence: Synthetic oligonucleotide
cccauccccaauccgagg

SEQ ID NO: 1936 - RNA, 18 nt, Artificial Sequence
  Description of Artificial Sequence: Synthetic oligonucleotide
ucccacccauccccaauc

SEQ ID NO: 1937 - RNA, 18 nt, Artificial Sequence
  Description of Artificial Sequence: Synthetic oligonucleotide
cccccucccacccauccc

SEQ ID NO: 1938 - RNA, 18 nt, Artificial Sequence
  Description of Artificial Sequence: Synthetic oligonucleotide
ugaaacccccucccaccc

SEQ ID NO: 1939 - RNA, 18 nt, Artificial Sequence
  Description of Artificial Sequence: Synthetic oligonucleotide
ccucuugaaacccccucc

SEQ ID NO: 1940 - RNA, 18 nt, Artificial Sequence
  Description of Artificial Sequence: Synthetic oligonucleotide
cuccuccucuugaaaccc

SEQ ID NO: 1941 - RNA, 18 nt, Artificial Sequence
  Description of Artificial Sequence: Synthetic oligonucleotide
ccacccuccuccucuuga

SEQ ID NO: 1942 - RNA, 18 nt, Artificial Sequence
  Description of Artificial Sequence: Synthetic oligonucleotide
ccaucccacccuccuccu

SEQ ID NO: 1943 - RNA, 18 nt, Artificial Sequence
  Description of Artificial Sequence: Synthetic oligonucleotide
cuugcccaucccacccuc

SEQ ID NO: 1944 - RNA, 18 nt, Artificial Sequence
  Description of Artificial Sequence: Synthetic oligonucleotide
uauuccuugcccauccca

SEQ ID NO: 1945 - RNA, 18 nt, Artificial Sequence
  Description of Artificial Sequence: Synthetic oligonucleotide
guguauauuccuugccca

SEQ ID NO: 1946 - RNA, 18 nt, Artificial Sequence
  Description of Artificial Sequence: Synthetic oligonucleotide
caccuguguauauuccuu

SEQ ID NO: 1947 - RNA, 18 nt, Artificial Sequence
  Description of Artificial Sequence: Synthetic oligonucleotide
ggcuucaccuguguauau

SEQ ID NO: 1948 - RNA, 18 nt, Artificial Sequence
  Description of Artificial Sequence: Synthetic oligonucleotide
ucucuggcuucaccugug

SEQ ID NO: 1949 - RNA, 18 nt, Artificial Sequence
  Description of Artificial Sequence: Synthetic oligonucleotide
acccuucucuggcuucac

SEQ ID NO: 1950 - RNA, 18 nt, Artificial Sequence
  Description of Artificial Sequence: Synthetic oligonucleotide
accuaacccuucucuggc

SEQ ID NO: 1951 - RNA, 18 nt, Artificial Sequence
  Description of Artificial Sequence: Synthetic oligonucleotide
ccccaaccuaacccuucu

SEQ ID NO: 1952 - RNA, 18 nt, Artificial Sequence
  Description of Artificial Sequence: Synthetic oligonucleotide
cgcacccccaaccuaacc

SEQ ID NO: 1953 - RNA, 18 nt, Artificial Sequence
  Description of Artificial Sequence: Synthetic oligonucleotide
cccaccgcacccccaacc

SEQ ID NO: 1954 - RNA, 18 nt, Artificial Sequence
  Description of Artificial Sequence: Synthetic oligonucleotide
aaguucccaccgcacccc

SEQ ID NO: 1955 - RNA, 18 nt, Artificial Sequence
  Description of Artificial Sequence: Synthetic oligonucleotide
acagcaaguucccaccgc

SEQ ID NO: 1956 - RNA, 18 nt, Artificial Sequence
  Description of Artificial Sequence: Synthetic oligonucleotide
ucaaaacagcaaguuccc

SEQ ID NO: 1957 - RNA, 18 nt, Artificial Sequence
  Description of Artificial Sequence: Synthetic oligonucleotide
ccagaucaaaacagcaag

SEQ ID NO: 1958 - RNA, 18 nt, Artificial Sequence
  Description of Artificial Sequence: Synthetic oligonucleotide
ggaaaccagaucaaaaca

SEQ ID NO: 1959 - RNA, 18 nt, Artificial Sequence
  Description of Artificial Sequence: Synthetic oligonucleotide
caccaggaaaccagauca

SEQ ID NO: 1960 - RNA, 18 nt, Artificial Sequence
  Description of Artificial Sequence: Synthetic oligonucleotide
ugucacaccaggaaacca

SEQ ID NO: 1961 - RNA, 18 nt, Artificial Sequence
  Description of Artificial Sequence: Synthetic oligonucleotide
cagagugucacaccagga

SEQ ID NO: 1962 - RNA, 18 nt, Artificial Sequence
  Description of Artificial Sequence: Synthetic oligonucleotide
uaacccagagugucacac

SEQ ID NO: 1963 - RNA, 18 nt, Artificial Sequence
  Description of Artificial Sequence: Synthetic oligonucleotide
gccuuuaacccagagugu

SEQ ID NO: 1964 - RNA, 18 nt, Artificial Sequence
  Description of Artificial Sequence: Synthetic oligonucleotide
uucaagccuuuaacccag

SEQ ID NO: 1965 - RNA, 18 nt, Artificial Sequence
  Description of Artificial Sequence: Synthetic oligonucleotide
gggccuucaagccuuuaa

SEQ ID NO: 1966 - RNA, 18 nt, Artificial Sequence
  Description of Artificial Sequence: Synthetic oligonucleotide
ccuagacuccuaacaggg

SEQ ID NO: 1967 - RNA, 18 nt, Artificial Sequence
  Description of Artificial Sequence: Synthetic oligonucleotide
ccccuagacuccuaacag

SEQ ID NO: 1968 - RNA, 18 nt, Artificial Sequence
  Description of Artificial Sequence: Synthetic oligonucleotide
ucucaccccuagacuccu

SEQ ID NO: 1969 - RNA, 18 nt, Artificial Sequence
  Description of Artificial Sequence: Synthetic oligonucleotide
gagaaucucaccccuaga

SEQ ID NO: 1970 - RNA, 18 nt, Artificial Sequence
  Description of Artificial Sequence: Synthetic oligonucleotide
gagaagagaaucucaccc

SEQ ID NO: 1971 - RNA, 18 nt, Artificial Sequence
  Description of Artificial Sequence: Synthetic oligonucleotide
ucagagagaagagaaucu

SEQ ID NO: 1972 - RNA, 18 nt, Artificial Sequence
  Description of Artificial Sequence: Synthetic oligonucleotide
ugggaucagagagaagag

SEQ ID NO: 1973 - RNA, 18 nt, Artificial Sequence
  Description of Artificial Sequence: Synthetic oligonucleotide
uccucugggaucagagag

SEQ ID NO: 1974 - RNA, 18 nt, Artificial Sequence
  Description of Artificial Sequence: Synthetic oligonucleotide
uaacguccucugggauca

SEQ ID NO: 1975 - RNA, 18 nt, Artificial Sequence
  Description of Artificial Sequence: Synthetic oligonucleotide
gaaguuaacguccucugg

SEQ ID NO: 1976 - RNA, 18 nt, Artificial Sequence
  Description of Artificial Sequence: Synthetic oligonucleotide
caguagaaguuaacgucc

SEQ ID NO: 1977 - RNA, 18 nt, Artificial Sequence
  Description of Artificial Sequence: Synthetic oligonucleotide
accugcaguagaaguuaa

SEQ ID NO: 1978 - RNA, 18 nt, Artificial Sequence
  Description of Artificial Sequence: Synthetic oligonucleotide
uucucaccugcaguagaa

SEQ ID NO: 1979 - RNA, 18 nt, Artificial Sequence
  Description of Artificial Sequence: Synthetic oligonucleotide
uuuguuucucaccugcag

SEQ ID NO: 1980 - RNA, 18 nt, Artificial Sequence
  Description of Artificial Sequence: Synthetic oligonucleotide
ccuauuuuguuucucacc

SEQ ID NO: 1981 - RNA, 18 nt, Artificial Sequence
  Description of Artificial Sequence: Synthetic oligonucleotide
auccuccuauuuuguuuc

SEQ ID NO: 1982 - RNA, 18 nt, Artificial Sequence
  Description of Artificial Sequence: Synthetic oligonucleotide
ccaccauccuccuauuuu

SEQ ID NO: 1983 - RNA, 18 nt, Artificial Sequence
  Description of Artificial Sequence: Synthetic oligonucleotide
aguccccaccauccuccu

SEQ ID NO: 1984 - RNA, 18 nt, Artificial Sequence
  Description of Artificial Sequence: Synthetic oligonucleotide
aggacaguccccaccauc

SEQ ID NO: 1985 - RNA, 18 nt, Artificial Sequence
  Description of Artificial Sequence: Synthetic oligonucleotide
cucccaggacagucccca

SEQ ID NO: 1986 - RNA, 18 nt, Artificial Sequence
  Description of Artificial Sequence: Synthetic oligonucleotide
cccuccucccaggacagu

SEQ ID NO: 1987 - RNA, 18 nt, Artificial Sequence
  Description of Artificial Sequence: Synthetic oligonucleotide
ccacccccuccucccagg

SEQ ID NO: 1988 - RNA, 18 nt, Artificial Sequence
  Description of Artificial Sequence: Synthetic oligonucleotide
auggaccacccccuccuc

SEQ ID NO: 1989 - RNA, 18 nt, Artificial Sequence
  Description of Artificial Sequence: Synthetic oligonucleotide
aagccauggaccaccccc

SEQ ID NO: 1990 - RNA, 18 nt, Artificial Sequence
  Description of Artificial Sequence: Synthetic oligonucleotide
accacaagccauggacca

SEQ ID NO: 1991 - RNA, 18 nt, Artificial Sequence
  Description of Artificial Sequence: Synthetic oligonucleotide
cccacaccacaagccaug

SEQ ID NO: 1992 - RNA, 18 nt, Artificial Sequence
  Description of Artificial Sequence: Synthetic oligonucleotide
gccagcccacaccacaag

SEQ ID NO: 1993 - RNA, 18 nt, Artificial Sequence
  Description of Artificial Sequence: Synthetic oligonucleotide
cuauagccagcccacacc

SEQ ID NO: 1994 - RNA, 18 nt, Artificial Sequence
  Description of Artificial Sequence: Synthetic oligonucleotide
cuccccuauagccagccc

SEQ ID NO: 1995 - RNA, 18 nt, Artificial Sequence
  Description of Artificial Sequence: Synthetic oligonucleotide
guggccuccccuauagcc

SEQ ID NO: 1996 - RNA, 18 nt, Artificial Sequence
  Description of Artificial Sequence: Synthetic oligonucleotide
uagcaguggccuccccua

SEQ ID NO: 1997 - RNA, 18 nt, Artificial Sequence
  Description of Artificial Sequence: Synthetic oligonucleotide
uccccuagcaguggccuc

SEQ ID NO: 1998 - RNA, 18 nt, Artificial Sequence
  Description of Artificial Sequence: Synthetic oligonucleotide
gccaguccccuagcagug

SEQ ID NO: 1999 - RNA, 18 nt, Artificial Sequence
  Description of Artificial Sequence: Synthetic oligonucleotide
uggaugccaguccccuag

SEQ ID NO: 2000 - RNA, 18 nt, Artificial Sequence
  Description of Artificial Sequence: Synthetic oligonucleotide
gggccuggaugccagucc

SEQ ID NO: 2001 - RNA, 18 nt, Artificial Sequence
  Description of Artificial Sequence: Synthetic oligonucleotide
auugagacgcuucaaggg

SEQ ID NO: 2002 - RNA, 18 nt, Artificial Sequence
  Description of Artificial Sequence: Synthetic oligonucleotide
uuauugagacgcuucaag

SEQ ID NO: 2003 - RNA, 18 nt, Artificial Sequence
  Description of Artificial Sequence: Synthetic oligonucleotide
cggacuuauugagacgcu

SEQ ID NO: 2004 - RNA, 18 nt, Artificial Sequence
  Description of Artificial Sequence: Synthetic oligonucleotide
gagcgcggacuuauugag

SEQ ID NO: 2005 - RNA, 18 nt, Artificial Sequence
  Description of Artificial Sequence: Synthetic oligonucleotide
aaggagagcgcggacuua

SEQ ID NO: 2006 - RNA, 18 nt, Artificial Sequence
  Description of Artificial Sequence: Synthetic oligonucleotide
gguuuguuggacccaagg

SEQ ID NO: 2007 - RNA, 18 nt, Artificial Sequence
  Description of Artificial Sequence: Synthetic oligonucleotide
acgcggguuuguuggacc

SEQ ID NO: 2008 - RNA, 18 nt, Artificial Sequence
  Description of Artificial Sequence: Synthetic oligonucleotide
gucacacgcggguuuguu

SEQ ID NO: 2009 - RNA, 18 nt, Artificial Sequence
  Description of Artificial Sequence: Synthetic oligonucleotide
ccagcgucacacgcgggu

SEQ ID NO: 2010 - RNA, 18 nt, Artificial Sequence
  Description of Artificial Sequence: Synthetic oligonucleotide
gggccagcgucacacgcg

SEQ ID NO: 2011 - RNA, 18 nt, Artificial Sequence
  Description of Artificial Sequence: Synthetic oligonucleotide
aggccauuccacgguggg

SEQ ID NO: 2012 - RNA, 18 nt, Artificial Sequence
  Description of Artificial Sequence: Synthetic oligonucleotide
gggccaggccauuccacg

SEQ ID NO: 2013 - RNA, 18 nt, Artificial Sequence
  Description of Artificial Sequence: Synthetic oligonucleotide
uccguaaucugcagccgg

SEQ ID NO: 2014 - RNA, 18 nt, Artificial Sequence
  Description of Artificial Sequence: Synthetic oligonucleotide
cguucuccguaaucugca

SEQ ID NO: 2015 - RNA, 18 nt, Artificial Sequence
  Description of Artificial Sequence: Synthetic oligonucleotide
cucgccguucuccguaau

SEQ ID NO: 2016 - RNA, 18 nt, Artificial Sequence
  Description of Artificial Sequence: Synthetic oligonucleotide
cggaacucgccguucucc

SEQ ID NO: 2017 - RNA, 18 nt, Artificial Sequence
  Description of Artificial Sequence: Synthetic oligonucleotide
uguuucggaacucgccgu

SEQ ID NO: 2018 - RNA, 18 nt, Artificial Sequence
  Description of Artificial Sequence: Synthetic oligonucleotide
ugcgguguuucggaacuc

SEQ ID NO: 2019 - RNA, 18 nt, Artificial Sequence
  Description of Artificial Sequence: Synthetic oligonucleotide
uggucugcgguguuucgg

SEQ ID NO: 2020 - RNA, 18 nt, Artificial Sequence
  Description of Artificial Sequence: Synthetic oligonucleotide
gcuaguggucugcggugu

SEQ ID NO: 2021 - RNA, 18 nt, Artificial Sequence
  Description of Artificial Sequence: Synthetic oligonucleotide
ggugggcuaguggucugc

SEQ ID NO: 2022 - RNA, 18 nt, Artificial Sequence
  Description of Artificial Sequence: Synthetic oligonucleotide
ugcugggugggcuagugg

SEQ ID NO: 2023 - RNA, 18 nt, Artificial Sequence
  Description of Artificial Sequence: Synthetic oligonucleotide
ucugaugcugggugggcu

SEQ ID NO: 2024 - RNA, 18 nt, Artificial Sequence
  Description of Artificial Sequence: Synthetic oligonucleotide
aggucucugaugcugggu

SEQ ID NO: 2025 - RNA, 18 nt, Artificial Sequence
  Description of Artificial Sequence: Synthetic oligonucleotide
agagaaggucucugaugc

SEQ ID NO: 2026 - RNA, 18 nt, Artificial Sequence
  Description of Artificial Sequence: Synthetic oligonucleotide
aaggaagagaaggucucu

SEQ ID NO: 2027 - RNA, 18 nt, Artificial Sequence
  Description of Artificial Sequence: Synthetic oligonucleotide
caggaaaggaagagaagg

SEQ ID NO: 2028 - RNA, 18 nt, Artificial Sequence
  Description of Artificial Sequence: Synthetic oligonucleotide
gugcacaggaaaggaaga

SEQ ID NO: 2029 - RNA, 18 nt, Artificial Sequence
  Description of Artificial Sequence: Synthetic oligonucleotide
gggugcacaggaaaggaa

SEQ ID NO: 2030 - RNA, 18 nt, Artificial Sequence
  Description of Artificial Sequence: Synthetic oligonucleotide
gugcuguuacaggguggg

SEQ ID NO: 2031 - RNA, 18 nt, Artificial Sequence
  Description of Artificial Sequence: Synthetic oligonucleotide
gguuggugcuguuacagg

SEQ ID NO: 2032 - RNA, 18 nt, Artificial Sequence
  Description of Artificial Sequence: Synthetic oligonucleotide
cuggugguuggugcuguu

SEQ ID NO: 2033 - RNA, 18 nt, Artificial Sequence
  Description of Artificial Sequence: Synthetic oligonucleotide
caauccuggugguuggug

SEQ ID NO: 2034 - RNA, 18 nt, Artificial Sequence
  Description of Artificial Sequence: Synthetic oligonucleotide
auguccaauccugguggu

SEQ ID NO: 2035 - RNA, 18 nt, Artificial Sequence
  Description of Artificial Sequence: Synthetic oligonucleotide
cggugauguccaauccug

SEQ ID NO: 2036 - RNA, 18 nt, Artificial Sequence
  Description of Artificial Sequence: Synthetic oligonucleotide
uuccucggugauguccaa

SEQ ID NO: 2037 - RNA, 18 nt, Artificial Sequence
  Description of Artificial Sequence: Synthetic oligonucleotide
cgcuguuccucggugaug

SEQ ID NO: 2038 - RNA, 18 nt, Artificial Sequence
  Description of Artificial Sequence: Synthetic oligonucleotide
aaucccgcuguuccucgg

SEQ ID NO: 2039 - RNA, 18 nt, Artificial Sequence
  Description of Artificial Sequence: Synthetic oligonucleotide
gaggcaaucccgcuguuc

SEQ ID NO: 2040 - RNA, 18 nt, Artificial Sequence
  Description of Artificial Sequence: Synthetic oligonucleotide
gggaggcaaucccgcugu

SEQ ID NO: 2041 - RNA, 18 nt, Artificial Sequence
  Description of Artificial Sequence: Synthetic oligonucleotide
cccagggaggcauucggg

SEQ ID NO: 2042 - RNA, 18 nt, Artificial Sequence
  Description of Artificial Sequence: Synthetic oligonucleotide
ugccucccagggaggcau

SEQ ID NO: 2043 - RNA, 18 nt, Artificial Sequence
  Description of Artificial Sequence: Synthetic oligonucleotide
cagugugccucccaggga

SEQ ID NO: 2044 - RNA, 18 nt, Artificial Sequence
  Description of Artificial Sequence: Synthetic oligonucleotide
gcaaucagugugccuccc

SEQ ID NO: 2045 - RNA, 18 nt, Artificial Sequence
  Description of Artificial Sequence: Synthetic oligonucleotide
ggugggcaaucagugugc

SEQ ID NO: 2046 - RNA, 18 nt, Artificial Sequence
  Description of Artificial Sequence: Synthetic oligonucleotide
gggugggcaaucagugug

SEQ ID NO: 2047 - RNA, 18 nt, Artificial Sequence
  Description of Artificial Sequence: Synthetic oligonucleotide
aaauggugcagugguggg

SEQ ID NO: 2048 - RNA, 18 nt, Artificial Sequence
  Description of Artificial Sequence: Synthetic oligonucleotide
ccuggaaauggugcagug

SEQ ID NO: 2049 - RNA, 18 nt, Artificial Sequence
  Description of Artificial Sequence: Synthetic oligonucleotide
ucccuccuggaaauggug

SEQ ID NO: 2050 - RNA, 18 nt, Artificial Sequence
  Description of Artificial Sequence: Synthetic oligonucleotide
cacucucccuccuggaaa

SEQ ID NO: 2051 - RNA, 18 nt, Artificial Sequence
  Description of Artificial Sequence: Synthetic oligonucleotide
guccccacucucccuccu

SEQ ID NO: 2052 - RNA, 18 nt, Artificial Sequence
  Description of Artificial Sequence: Synthetic oligonucleotide
ugaggguccccacucucc

SEQ ID NO: 2053 - RNA, 18 nt, Artificial Sequence
  Description of Artificial Sequence: Synthetic oligonucleotide
gcggcugaggguccccac

SEQ ID NO: 2054 - RNA, 18 nt, Artificial Sequence
  Description of Artificial Sequence: Synthetic oligonucleotide
gggcggcugagggucccc

SEQ ID NO: 2055 - RNA, 18 nt, Artificial Sequence
  Description of Artificial Sequence: Synthetic oligonucleotide
caaugggaaggaaaaggg

SEQ ID NO: 2056 - RNA, 18 nt, Artificial Sequence
  Description of Artificial Sequence: Synthetic oligonucleotide
caccccaaugggaaggaa

SEQ ID NO: 2057 - RNA, 18 nt, Artificial Sequence
  Description of Artificial Sequence: Synthetic oligonucleotide
ggcagcaccccaauggga

SEQ ID NO: 2058 - RNA, 18 nt, Artificial Sequence
  Description of Artificial Sequence: Synthetic oligonucleotide
gagagggcagcaccccaa

SEQ ID NO: 2059 - RNA, 18 nt, Artificial Sequence
  Description of Artificial Sequence: Synthetic oligonucleotide
ucaaagagagggcagcac

SEQ ID NO: 2060 - RNA, 18 nt, Artificial Sequence
  Description of Artificial Sequence: Synthetic oligonucleotide
gggucaaagagagggcag

SEQ ID NO: 2061 - RNA, 18 nt, Artificial Sequence
  Description of Artificial Sequence: Synthetic oligonucleotide
gguaggcgguguccuggg

SEQ ID NO: 2062 - RNA, 18 nt, Artificial Sequence
  Description of Artificial Sequence: Synthetic oligonucleotide
ggguaggcgguguccugg

SEQ ID NO: 2063 - RNA, 18 nt, Artificial Sequence
  Description of Artificial Sequence: Synthetic oligonucleotide
gcaccccggagugaaggg

SEQ ID NO: 2064 - RNA, 18 nt, Artificial Sequence
  Description of Artificial Sequence: Synthetic oligonucleotide
ggauagcaccccggagug

SEQ ID NO: 2065 - RNA, 18 nt, Artificial Sequence
  Description of Artificial Sequence: Synthetic oligonucleotide
gggauagcaccccggagu

SEQ ID NO: 2066 - RNA, 18 nt, Artificial Sequence
  Description of Artificial Sequence: Synthetic oligonucleotide
gaugaggcagaggauggg

SEQ ID NO: 2067 - RNA, 18 nt, Artificial Sequence
  Description of Artificial Sequence: Synthetic oligonucleotide
ggaacgaugaggcagagg

SEQ ID NO: 2068 - RNA, 18 nt, Artificial Sequence
  Description of Artificial Sequence: Synthetic oligonucleotide
gggaacgaugaggcagag

SEQ ID NO: 2069 - RNA, 18 nt, Artificial Sequence
  Description of Artificial Sequence: Synthetic oligonucleotide
gucccccagugcucaggg

SEQ ID NO: 2070 - RNA, 18 nt, Artificial Sequence
  Description of Artificial Sequence: Synthetic oligonucleotide
ggucugucccccagugcu

SEQ ID NO: 2071 - RNA, 18 nt, Artificial Sequence
  Description of Artificial Sequence: Synthetic oligonucleotide
gugagggucuguccccca

SEQ ID NO: 2072 - RNA, 18 nt, Artificial Sequence
  Description of Artificial Sequence: Synthetic oligonucleotide
gggugagggucugucccc

SEQ ID NO: 2073 - RNA, 18 nt, Artificial Sequence
  Description of Artificial Sequence: Synthetic oligonucleotide
ccacacccccaggguggg

SEQ ID NO: 2074 - RNA, 18 nt, Artificial Sequence
  Description of Artificial Sequence: Synthetic oligonucleotide
aggugccacacccccagg

SEQ ID NO: 2075 - RNA, 18 nt, Artificial Sequence
  Description of Artificial Sequence: Synthetic oligonucleotide
uuuggaggugccacaccc

SEQ ID NO: 2076 - RNA, 18 nt, Artificial Sequence
  Description of Artificial Sequence: Synthetic oligonucleotide
gaaaguuuggaggugcca

SEQ ID NO: 2077 - RNA, 18 nt, Artificial Sequence
  Description of Artificial Sequence: Synthetic oligonucleotide
aaguugaaaguuuggagg

SEQ ID NO: 2078 - RNA, 18 nt, Artificial Sequence
  Description of Artificial Sequence: Synthetic oligonucleotide
cccugaaguugaaaguuu

SEQ ID NO: 2079 - RNA, 18 nt, Artificial Sequence
  Description of Artificial Sequence: Synthetic oligonucleotide
aaucacccugaaguugaa

SEQ ID NO: 2080 - RNA, 18 nt, Artificial Sequence
  Description of Artificial Sequence: Synthetic oligonucleotide
aaaaaaaucacccugaag

SEQ ID NO: 2081 - RNA, 18 nt, Artificial Sequence
  Description of Artificial Sequence: Synthetic oligonucleotide
cugcuaaaaaaaucaccc

SEQ ID NO: 2082 - RNA, 18 nt, Artificial Sequence
  Description of Artificial Sequence: Synthetic oligonucleotide
gguuacugcuaaaaaaau

SEQ ID NO: 2083 - RNA, 18 nt, Artificial Sequence
  Description of Artificial Sequence: Synthetic oligonucleotide
gcucugguuacugcuaaa

SEQ ID NO: 2084 - RNA, 18 nt, Artificial Sequence
  Description of Artificial Sequence: Synthetic oligonucleotide
ugucagcucugguuacug

SEQ ID NO: 2085 - RNA, 18 nt, Artificial Sequence
  Description of Artificial Sequence: Synthetic oligonucleotide
uagauugucagcucuggu

SEQ ID NO: 2086 - RNA, 18 nt, Artificial Sequence
  Description of Artificial Sequence: Synthetic oligonucleotide
ggaguuagauugucagcu

SEQ ID NO: 2087 - RNA, 18 nt, Artificial Sequence
  Description of Artificial Sequence: Synthetic oligonucleotide
gggaguuagauugucagc

SEQ ID NO: 2088 - RNA, 18 nt, Artificial Sequence
  Description of Artificial Sequence: Synthetic oligonucleotide
cccuccccauaacaaggg

SEQ ID NO: 2089 - RNA, 18 nt, Artificial Sequence
  Description of Artificial Sequence: Synthetic oligonucleotide
ggguccccuccccauaac

SEQ ID NO: 2090 - RNA, 18 nt, Artificial Sequence
  Description of Artificial Sequence: Synthetic oligonucleotide
uaauagggcccccucacc

SEQ ID NO: 2091 - RNA, 18 nt, Artificial Sequence
  Description of Artificial Sequence: Synthetic oligonucleotide
ggguaauagggcccccuc

SEQ ID NO: 2092 - RNA, 18 nt, Artificial Sequence
  Description of Artificial Sequence: Synthetic oligonucleotide
cuccugagaaaucaaggg

SEQ ID NO: 2093 - RNA, 18 nt, Artificial Sequence
  Description of Artificial Sequence: Synthetic oligonucleotide
agacgcuccugagaaauc

SEQ ID NO: 2094 - RNA, 18 nt, Artificial Sequence
  Description of Artificial Sequence: Synthetic oligonucleotide
cccccagacgcuccugag

SEQ ID NO: 2095 - RNA, 18 nt, Artificial Sequence
  Description of Artificial Sequence: Synthetic oligonucleotide
gagcccccccagacgcuc

SEQ ID NO: 2096 - RNA, 18 nt, Artificial Sequence
  Description of Artificial Sequence: Synthetic oligonucleotide
gugcugagcccccccaga

SEQ ID NO: 2097 - RNA, 18 nt, Artificial Sequence
  Description of Artificial Sequence: Synthetic oligonucleotide
ugugcgugcugagccccc

SEQ ID NO: 2098 - RNA, 18 nt, Artificial Sequence
  Description of Artificial Sequence: Synthetic oligonucleotide
gaguuugugcgugcugag

SEQ ID NO: 2099 - RNA, 18 nt, Artificial Sequence
  Description of Artificial Sequence: Synthetic oligonucleotide
agaaggaguuugugcgug

SEQ ID NO: 2100 - RNA, 18 nt, Artificial Sequence
  Description of Artificial Sequence: Synthetic oligonucleotide
gaaggagaaggaguuugu

SEQ ID NO: 2101 - RNA, 18 nt, Artificial Sequence
  Description of Artificial Sequence: Synthetic oligonucleotide
ugguagaaggagaaggag

SEQ ID NO: 2102 - RNA, 18 nt, Artificial Sequence
  Description of Artificial Sequence: Synthetic oligonucleotide
aagagugguagaaggaga

SEQ ID NO: 2103 - RNA, 18 nt, Artificial Sequence
  Description of Artificial Sequence: Synthetic oligonucleotide
aauuuaagagugguagaa

SEQ ID NO: 2104 - RNA, 18 nt, Artificial Sequence
  Description of Artificial Sequence: Synthetic oligonucleotide
gaguaaauuuaagagugg

SEQ ID NO: 2105 - RNA, 18 nt, Artificial Sequence
  Description of Artificial Sequence: Synthetic oligonucleotide
ggagggaguaaauuuaag

SEQ ID NO: 2106 - RNA, 18 nt, Artificial Sequence
  Description of Artificial Sequence: Synthetic oligonucleotide
gggagggaguaaauuuaa

SEQ ID NO: 2107 - RNA, 18 nt, Artificial Sequence
  Description of Artificial Sequence: Synthetic oligonucleotide
aucuggguucuggguggg

SEQ ID NO: 2108 - RNA, 18 nt, Artificial Sequence
  Description of Artificial Sequence: Synthetic oligonucleotide
accccaucuggguucugg

SEQ ID NO: 2109 - RNA, 18 nt, Artificial Sequence
  Description of Artificial Sequence: Synthetic oligonucleotide
ccuccaccccaucugggu

SEQ ID NO: 2110 - RNA, 18 nt, Artificial Sequence
  Description of Artificial Sequence: Synthetic oligonucleotide
ggcccccuccaccccauc

SEQ ID NO: 2111 - RNA, 18 nt, Artificial Sequence
  Description of Artificial Sequence: Synthetic oligonucleotide
ccgguggcccccuccacc

SEQ ID NO: 2112 - RNA, 18 nt, Artificial Sequence
  Description of Artificial Sequence: Synthetic oligonucleotide
cugccccgguggcccccu

SEQ ID NO: 2113 - RNA, 18 nt, Artificial Sequence
  Description of Artificial Sequence: Synthetic oligonucleotide
ccucccugccccgguggc

SEQ ID NO: 2114 - RNA, 18 nt, Artificial Sequence
  Description of Artificial Sequence: Synthetic oligonucleotide
cgcccccucccugccccg

SEQ ID NO: 2115 - RNA, 18 nt, Artificial Sequence
  Description of Artificial Sequence: Synthetic oligonucleotide
cuugccgcccccucccug

SEQ ID NO: 2116 - RNA, 18 nt, Artificial Sequence
  Description of Artificial Sequence: Synthetic oligonucleotide
ccccccuugccgcccccu

SEQ ID NO: 2117 - RNA, 18 nt, Artificial Sequence
  Description of Artificial Sequence: Synthetic oligonucleotide
ccauuccccccuugccgc

SEQ ID NO: 2118 - RNA, 18 nt, Artificial Sequence
  Description of Artificial Sequence: Synthetic oligonucleotide
aacucccauuccccccuu

SEQ ID NO: 2119 - RNA, 18 nt, Artificial Sequence
  Description of Artificial Sequence: Synthetic oligonucleotide
gagacaacucccauuccc

SEQ ID NO: 2120 - RNA, 18 nt, Artificial Sequence
  Description of Artificial Sequence: Synthetic oligonucleotide
gggagacaacucccauuc

SEQ ID NO: 2121 - RNA, 18 nt, Artificial Sequence
  Description of Artificial Sequence: Synthetic oligonucleotide
gagcagaucagguguggg

SEQ ID NO: 2122 - RNA, 18 nt, Artificial Sequence
  Description of Artificial Sequence: Synthetic oligonucleotide
gccgagagcagaucaggu

SEQ ID NO: 2123 - RNA, 18 nt, Artificial Sequence
  Description of Artificial Sequence: Synthetic oligonucleotide
gaccagccgagagcagau

SEQ ID NO: 2124 - RNA, 18 nt, Artificial Sequence
  Description of Artificial Sequence: Synthetic oligonucleotide
ucugggaccagccgagag

SEQ ID NO: 2125 - RNA, 18 nt, Artificial Sequence
  Description of Artificial Sequence: Synthetic oligonucleotide
cccgcucugggaccagcc

SEQ ID NO: 2126 - RNA, 18 nt, Artificial Sequence
  Description of Artificial Sequence: Synthetic oligonucleotide
cucaccccgcucugggac

SEQ ID NO: 2127 - RNA, 18 nt, Artificial Sequence
  Description of Artificial Sequence: Synthetic oligonucleotide
gcccccucaccccgcucu

SEQ ID NO: 2128 - RNA, 18 nt, Artificial Sequence
  Description of Artificial Sequence: Synthetic oligonucleotide
cauaagcccccucacccc

SEQ ID NO: 2129 - RNA, 18 nt, Artificial Sequence
  Description of Artificial Sequence: Synthetic oligonucleotide
gggcauaagcccccucac

SEQ ID NO: 2130 - RNA, 18 nt, Artificial Sequence
  Description of Artificial Sequence: Synthetic oligonucleotide
cccacccaacacacuggg

SEQ ID NO: 2131 - RNA, 18 nt, Artificial Sequence
  Description of Artificial Sequence: Synthetic oligonucleotide
uccaccccacccaacaca

SEQ ID NO: 2132 - RNA, 18 nt, Artificial Sequence
  Description of Artificial Sequence: Synthetic oligonucleotide
ucaauuccaccccaccca

SEQ ID NO: 2133 - RNA, 18 nt, Artificial Sequence
  Description of Artificial Sequence: Synthetic oligonucleotide
uaaccucaauuccacccc

SEQ ID NO: 2134 - RNA, 18 nt, Artificial Sequence
  Description of Artificial Sequence: Synthetic oligonucleotide
cacccuaaccucaauucc

SEQ ID NO: 2135 - RNA, 18 nt, Artificial Sequence
  Description of Artificial Sequence: Synthetic oligonucleotide
ccccucacccuaaccuca

SEQ ID NO: 2136 - RNA, 18 nt, Artificial Sequence
  Description of Artificial Sequence: Synthetic oligonucleotide
ccugaccccucacccuaa

SEQ ID NO: 2137 - RNA, 18 nt, Artificial Sequence
  Description of Artificial Sequence: Synthetic oligonucleotide
uaaacccugaccccucac

SEQ ID NO: 2138 - RNA, 18 nt, Artificial Sequence
  Description of Artificial Sequence: Synthetic oligonucleotide
ccuccuaaacccugaccc

SEQ ID NO: 2139 - RNA, 18 nt, Artificial Sequence
  Description of Artificial Sequence: Synthetic oligonucleotide
cacacccuccuaaacccu

SEQ ID NO: 2140 - RNA, 18 nt, Artificial Sequence
  Description of Artificial Sequence: Synthetic oligonucleotide
acauacacacccuccuaa

SEQ ID NO: 2141 - RNA, 18 nt, Artificial Sequence
  Description of Artificial Sequence: Synthetic oligonucleotide
ucccaacauacacacccu

SEQ ID NO: 2142 - RNA, 18 nt, Artificial Sequence
  Description of Artificial Sequence: Synthetic oligonucleotide
uguccucccaacauacac

SEQ ID NO: 2143 - RNA, 18 nt, Artificial Sequence
  Description of Artificial Sequence: Synthetic oligonucleotide
uagccuguccucccaaca

SEQ ID NO: 2144 - RNA, 18 nt, Artificial Sequence
  Description of Artificial Sequence: Synthetic oligonucleotide
ucaacuagccuguccucc

SEQ ID NO: 2145 - RNA, 18 nt, Artificial Sequence
  Description of Artificial Sequence: Synthetic oligonucleotide
acagaucaacuagccugu

SEQ ID NO: 2146 - RNA, 18 nt, Artificial Sequence
  Description of Artificial Sequence: Synthetic oligonucleotide
guaggacagaucaacuag

SEQ ID NO: 2147 - RNA, 18 nt, Artificial Sequence
  Description of Artificial Sequence: Synthetic oligonucleotide
ucagaguaggacagauca

SEQ ID NO: 2148 - RNA, 18 nt, Artificial Sequence
  Description of Artificial Sequence: Synthetic oligonucleotide
gugugucagaguaggaca

SEQ ID NO: 2149 - RNA, 18 nt, Artificial Sequence
  Description of Artificial Sequence: Synthetic oligonucleotide
ggacugugugucagagua

SEQ ID NO: 2150 - RNA, 18 nt, Artificial Sequence
  Description of Artificial Sequence: Synthetic oligonucleotide
gggacugugugucagagu

SEQ ID NO: 2151 - RNA, 18 nt, Artificial Sequence
  Description of Artificial Sequence: Synthetic oligonucleotide
agaagagagaaggaaggg

SEQ ID NO: 2152 - RNA, 18 nt, Artificial Sequence
  Description of Artificial Sequence: Synthetic oligonucleotide
gaccaagaagagagaagg

SEQ ID NO: 2153 - RNA, 18 nt, Artificial Sequence
  Description of Artificial Sequence: Synthetic oligonucleotide
guagagaccaagaagaga

SEQ ID NO: 2154 - RNA, 18 nt, Artificial Sequence
  Description of Artificial Sequence: Synthetic oligonucleotide
ugggaguagagaccaaga

SEQ ID NO: 2155 - RNA, 18 nt, Artificial Sequence
  Description of Artificial Sequence: Synthetic oligonucleotide
cccccugggaguagagac

SEQ ID NO: 2156 - RNA, 18 nt, Artificial Sequence
  Description of Artificial Sequence: Synthetic oligonucleotide
ccccucccccugggagua

SEQ ID NO: 2157 - RNA, 18 nt, Artificial Sequence
  Description of Artificial Sequence: Synthetic oligonucleotide
guuccccccucccccugg

SEQ ID NO: 2158 - RNA, 18 nt, Artificial Sequence
  Description of Artificial Sequence: Synthetic oligonucleotide
aguaaguuccccccuccc

SEQ ID NO: 2159 - RNA, 18 nt, Artificial Sequence
  Description of Artificial Sequence: Synthetic oligonucleotide
ccuagaguaaguuccccc

SEQ ID NO: 2160 - RNA, 18 nt, Artificial Sequence
  Description of Artificial Sequence: Synthetic oligonucleotide
cuuuuccuagaguaaguu

SEQ ID NO: 2161 - RNA, 18 nt, Artificial Sequence
  Description of Artificial Sequence: Synthetic oligonucleotide
cauggcuuuuccuagagu

SEQ ID NO: 2162 - RNA, 18 nt, Artificial Sequence
  Description of Artificial Sequence: Synthetic oligonucleotide
agagacauggcuuuuccu

SEQ ID NO: 2163 - RNA, 18 nt, Artificial Sequence
  Description of Artificial Sequence: Synthetic oligonucleotide
gggagagagacauggcuu

SEQ ID NO: 2164 - RNA, 18 nt, Artificial Sequence
  Description of Artificial Sequence: Synthetic oligonucleotide
cacagguccccccacccu

SEQ ID NO: 2165 - RNA, 18 nt, Artificial Sequence
  Description of Artificial Sequence: Synthetic oligonucleotide
uccaacacaggucccccc

SEQ ID NO: 2166 - RNA, 18 nt, Artificial Sequence
  Description of Artificial Sequence: Synthetic oligonucleotide
ccuccuccaacacagguc

SEQ ID NO: 2167 - RNA, 18 nt, Artificial Sequence
  Description of Artificial Sequence: Synthetic oligonucleotide
acaccccuccuccaacac

SEQ ID NO: 2168 - RNA, 18 nt, Artificial Sequence
  Description of Artificial Sequence: Synthetic oligonucleotide
ccccaacaccccuccucc

SEQ ID NO: 2169 - RNA, 18 nt, Artificial Sequence
  Description of Artificial Sequence: Synthetic oligonucleotide
gggccccccaacaccccu

SEQ ID NO: 2170 - RNA, 18 nt, Artificial Sequence
  Description of Artificial Sequence: Synthetic oligonucleotide
gggacagagucauggaag

SEQ ID NO: 2171 - RNA, 18 nt, Artificial Sequence
  Description of Artificial Sequence: Synthetic oligonucleotide
guccuaccucccccaggg

SEQ ID NO: 2172 - RNA, 18 nt, Artificial Sequence
  Description of Artificial Sequence: Synthetic oligonucleotide
gcccuguccuaccucccc

SEQ ID NO: 2173 - RNA, 18 nt, Artificial Sequence
  Description of Artificial Sequence: Synthetic oligonucleotide
gcccagcccuguccuacc

SEQ ID NO: 2174 - RNA, 18 nt, Artificial Sequence
  Description of Artificial Sequence: Synthetic oligonucleotide
gggaagcccagcccuguc

SEQ ID NO: 2175 - RNA, 18 nt, Artificial Sequence
  Description of Artificial Sequence: Synthetic oligonucleotide
ugagagggaagcccagcc

SEQ ID NO: 2176 - RNA, 18 nt, Artificial Sequence
  Description of Artificial Sequence: Synthetic oligonucleotide
gaggaugagagggaagcc

SEQ ID NO: 2177 - RNA, 18 nt, Artificial Sequence
  Description of Artificial Sequence: Synthetic oligonucleotide
gggaggaugagagggaag

SEQ ID NO: 2178 - RNA, 18 nt, Artificial Sequence
  Description of Artificial Sequence: Synthetic oligonucleotide
ggaaggagauugggaggg

SEQ ID NO: 2179 - RNA, 18 nt, Artificial Sequence
  Description of Artificial Sequence: Synthetic oligonucleotide
gagguggaaggagauugg

SEQ ID NO: 2180 - RNA, 18 nt, Artificial Sequence
  Description of Artificial Sequence: Synthetic oligonucleotide
ggagggagguggaaggag

SEQ ID NO: 2181 - RNA, 18 nt, Artificial Sequence
  Description of Artificial Sequence: Synthetic oligonucleotide
gggagggagggaggugga

SEQ ID NO: 2182 - RNA, 18 nt, Artificial Sequence
  Description of Artificial Sequence: Synthetic oligonucleotide
cuggcgggagggagggag

SEQ ID NO: 2183 - RNA, 18 nt, Artificial Sequence
  Description of Artificial Sequence: Synthetic oligonucleotide
uggagcuggcgggaggga

SEQ ID NO: 2184 - RNA, 18 nt, Artificial Sequence
  Description of Artificial Sequence: Synthetic oligonucleotide
aaucguggagcuggcggg

SEQ ID NO: 2185 - RNA, 18 nt, Artificial Sequence
  Description of Artificial Sequence: Synthetic oligonucleotide
cgaaaaaucguggagcug

SEQ ID NO: 2186 - RNA, 18 nt, Artificial Sequence
  Description of Artificial Sequence: Synthetic oligonucleotide
aacaccgaaaaaucgugg

SEQ ID NO: 2187 - RNA, 18 nt, Artificial Sequence
  Description of Artificial Sequence: Synthetic oligonucleotide
agagaaacaccgaaaaau

SEQ ID NO: 2188 - RNA, 18 nt, Artificial Sequence
  Description of Artificial Sequence: Synthetic oligonucleotide
uguacagagaaacaccga

SEQ ID NO: 2189 - RNA, 18 nt, Artificial Sequence
  Description of Artificial Sequence: Synthetic oligonucleotide
aacuauguacagagaaac

SEQ ID NO: 2190 - RNA, 18 nt, Artificial Sequence
  Description of Artificial Sequence: Synthetic oligonucleotide
cagaaaacuauguacaga

SEQ ID NO: 2191 - RNA, 18 nt, Artificial Sequence
  Description of Artificial Sequence: Synthetic oligonucleotide
cccgccagaaaacuaugu

SEQ ID NO: 2192 - RNA, 18 nt, Artificial Sequence
  Description of Artificial Sequence: Synthetic oligonucleotide
ccuaucccgccagaaaac

SEQ ID NO: 2193 - RNA, 18 nt, Artificial Sequence
  Description of Artificial Sequence: Synthetic oligonucleotide
ccuccccuaucccgccag

SEQ ID NO: 2194 - RNA, 18 nt, Artificial Sequence
  Description of Artificial Sequence: Synthetic oligonucleotide
uccuaccuccccuauccc

SEQ ID NO: 2195 - RNA, 18 nt, Artificial Sequence
  Description of Artificial Sequence: Synthetic oligonucleotide
auccauccuaccuccccu

SEQ ID NO: 2196 - RNA, 18 nt, Artificial Sequence
  Description of Artificial Sequence: Synthetic oligonucleotide
accccauccauccuaccu

SEQ ID NO: 2197 - RNA, 18 nt, Artificial Sequence
  Description of Artificial Sequence: Synthetic oligonucleotide
cccaaaccccauccaucc

SEQ ID NO: 2198 - RNA, 18 nt, Artificial Sequence
  Description of Artificial Sequence: Synthetic oligonucleotide
cccaccccaaaccccauc

SEQ ID NO: 2199 - RNA, 18 nt, Artificial Sequence
  Description of Artificial Sequence: Synthetic oligonucleotide
gccuacccaccccaaacc

SEQ ID NO: 2200 - RNA, 18 nt, Artificial Sequence
  Description of Artificial Sequence: Synthetic oligonucleotide
ccauggccuacccacccc

SEQ ID NO: 2201 - RNA, 18 nt, Artificial Sequence
  Description of Artificial Sequence: Synthetic oligonucleotide
cccucccauggccuaccc

SEQ ID NO: 2202 - RNA, 18 nt, Artificial Sequence
  Description of Artificial Sequence: Synthetic oligonucleotide
uucuccccucccauggcc

SEQ ID NO: 2203 - RNA, 18 nt, Artificial Sequence
  Description of Artificial Sequence: Synthetic oligonucleotide
gggcuucuccccucccau

SEQ ID NO: 2204 - RNA, 18 nt, Artificial Sequence
  Description of Artificial Sequence: Synthetic oligonucleotide
agcagucagggaagaggg

SEQ ID NO: 2205 - RNA, 18 nt, Artificial Sequence
  Description of Artificial Sequence: Synthetic oligonucleotide
gggacagcagucagggaa

SEQ ID NO: 2206 - RNA, 18 nt, Artificial Sequence
  Description of Artificial Sequence: Synthetic oligonucleotide
gggcaaggcuggguaggg

SEQ ID NO: 2207 - RNA, 18 nt, Artificial Sequence
  Description of Artificial Sequence: Synthetic oligonucleotide
acgcaaaaggaugaaggg

SEQ ID NO: 2208 - RNA, 18 nt, Artificial Sequence
  Description of Artificial Sequence: Synthetic oligonucleotide
accaaacgcaaaaggaug

SEQ ID NO: 2209 - RNA, 18 nt, Artificial Sequence
  Description of Artificial Sequence: Synthetic oligonucleotide
ucaauaccaaacgcaaaa

SEQ ID NO: 2210 - RNA, 18 nt, Artificial Sequence
  Description of Artificial Sequence: Synthetic oligonucleotide
gagucucaauaccaaacg

SEQ ID NO: 2211 - RNA, 18 nt, Artificial Sequence
  Description of Artificial Sequence: Synthetic oligonucleotide
uaggagagucucaauacc

SEQ ID NO: 2212 - RNA, 18 nt, Artificial Sequence
  Description of Artificial Sequence: Synthetic oligonucleotide
gagucuaggagagucuca

SEQ ID NO: 2213 - RNA, 18 nt, Artificial Sequence
  Description of Artificial Sequence: Synthetic oligonucleotide
gaguagagucuaggagag

SEQ ID NO: 2214 - RNA, 18 nt, Artificial Sequence
  Description of Artificial Sequence: Synthetic oligonucleotide
aagaggaguagagucuag

SEQ ID NO: 2215 - RNA, 18 nt, Artificial Sequence
  Description of Artificial Sequence: Synthetic oligonucleotide
aaagaaagaggaguagag

SEQ ID NO: 2216 - RNA, 18 nt, Artificial Sequence
  Description of Artificial Sequence: Synthetic oligonucleotide
auacaaaagaaagaggag

SEQ ID NO: 2217 - RNA, 18 nt, Artificial Sequence
  Description of Artificial Sequence: Synthetic oligonucleotide
uguccauacaaaagaaag

SEQ ID NO: 2218 - RNA, 18 nt, Artificial Sequence
  Description of Artificial Sequence: Synthetic oligonucleotide
ggaacuguccauacaaaa

SEQ ID NO: 2219 - RNA, 18 nt, Artificial Sequence
  Description of Artificial Sequence: Synthetic oligonucleotide
gggaacuguccauacaaa

SEQ ID NO: 2220 - RNA, 18 nt, Artificial Sequence
  Description of Artificial Sequence: Synthetic oligonucleotide
cuggguguauguguaggg

SEQ ID NO: 2221 - RNA, 18 nt, Artificial Sequence
  Description of Artificial Sequence: Synthetic oligonucleotide
cccggcuggguguaugug

SEQ ID NO: 2222 - RNA, 18 nt, Artificial Sequence
  Description of Artificial Sequence: Synthetic oligonucleotide
uuggccccggcugggugu

SEQ ID NO: 2223 - RNA, 18 nt, Artificial Sequence
  Description of Artificial Sequence: Synthetic oligonucleotide
uaaauuuggccccggcug

SEQ ID NO: 2224 - RNA, 18 nt, Artificial Sequence
  Description of Artificial Sequence: Synthetic oligonucleotide
aaguauaaauuuggcccc

SEQ ID NO: 2225 - RNA, 18 nt, Artificial Sequence
  Description of Artificial Sequence: Synthetic oligonucleotide
uauauaaguauaaauuug

SEQ ID NO: 2226 - RNA, 18 nt, Artificial Sequence
  Description of Artificial Sequence: Synthetic oligonucleotide
acuuuuauauaaguauaa

SEQ ID NO: 2227 - RNA, 18 nt, Artificial Sequence
  Description of Artificial Sequence: Synthetic oligonucleotide
uuacaacuuuuauauaag

SEQ ID NO: 2228 - RNA, 18 nt, Artificial Sequence
  Description of Artificial Sequence: Synthetic oligonucleotide
cauauuuacaacuuuuau

SEQ ID NO: 2229 - RNA, 18 nt, Artificial Sequence
  Description of Artificial Sequence: Synthetic oligonucleotide
uuucacauauuuacaacu

SEQ ID NO: 2230 - RNA, 18 nt, Artificial Sequence
  Description of Artificial Sequence: Synthetic oligonucleotide
uaaaauuucacauauuua

SEQ ID NO: 2231 - RNA, 18 nt, Artificial Sequence
  Description of Artificial Sequence: Synthetic oligonucleotide
agggauaaaauuucacau

SEQ ID NO: 2232 - RNA, 18 nt, Artificial Sequence
  Description of Artificial Sequence: Synthetic oligonucleotide
ggcacagggauaaaauuu

SEQ ID NO: 2233 - RNA, 18 nt, Artificial Sequence
  Description of Artificial Sequence: Synthetic oligonucleotide
gaaagggcacagggauaa

SEQ ID NO: 2234 - RNA, 18 nt, Artificial Sequence
  Description of Artificial Sequence: Synthetic oligonucleotide
gggaaagggcacagggau

SEQ ID NO: 2235 - RNA, 18 nt, Artificial Sequence
  Description of Artificial Sequence: Synthetic oligonucleotide
gguagggccugagguggg

SEQ ID NO: 2236 - RNA, 18 nt, Artificial Sequence
  Description of Artificial Sequence: Synthetic oligonucleotide
ggguagggccugaggugg

SEQ ID NO: 2237 - RNA, 18 nt, Artificial Sequence
  Description of Artificial Sequence: Synthetic oligonucleotide
gagagaaggaagguuggg

SEQ ID NO: 2238 - RNA, 18 nt, Artificial Sequence
  Description of Artificial Sequence: Synthetic oligonucleotide
aagaagagagaaggaagg

SEQ ID NO: 2239 - RNA, 18 nt, Artificial Sequence
  Description of Artificial Sequence: Synthetic oligonucleotide
agccaaagaagagagaag

SEQ ID NO: 2240 - RNA, 18 nt, Artificial Sequence
  Description of Artificial Sequence: Synthetic oligonucleotide
acaacagccaaagaagag

SEQ ID NO: 2241 - RNA, 18 nt, Artificial Sequence
  Description of Artificial Sequence: Synthetic oligonucleotide
uaauuacaacagccaaag

SEQ ID NO: 2242 - RNA, 18 nt, Artificial Sequence
  Description of Artificial Sequence: Synthetic oligonucleotide
ccagauaauuacaacagc

SEQ ID NO: 2243 - RNA, 18 nt, Artificial Sequence
  Description of Artificial Sequence: Synthetic oligonucleotide
aaaccccagauaauuaca

SEQ ID NO: 2244 - RNA, 18 nt, Artificial Sequence
  Description of Artificial Sequence: Synthetic oligonucleotide
aguacaaaccccagauaa

SEQ ID NO: 2245 - RNA, 18 nt, Artificial Sequence
  Description of Artificial Sequence: Synthetic oligonucleotide
uguacaguacaaacccca

SEQ ID NO: 2246 - RNA, 18 nt, Artificial Sequence
  Description of Artificial Sequence: Synthetic oligonucleotide
ggauauguacaguacaaa

SEQ ID NO: 2247 - RNA, 18 nt, Artificial Sequence
  Description of Artificial Sequence: Synthetic oligonucleotide
accccggauauguacagu

SEQ ID NO: 2248 - RNA, 18 nt, Artificial Sequence
  Description of Artificial Sequence: Synthetic oligonucleotide
cacacaccccggauaugu

SEQ ID NO: 2249 - RNA, 18 nt, Artificial Sequence
  Description of Artificial Sequence: Synthetic oligonucleotide
acacacacacaccccgga

SEQ ID NO: 2250 - RNA, 18 nt, Artificial Sequence
  Description of Artificial Sequence: Synthetic oligonucleotide
agcccacacacacacacc

SEQ ID NO: 2251 - RNA, 18 nt, Artificial Sequence
  Description of Artificial Sequence: Synthetic oligonucleotide
cccccagcccacacacac

SEQ ID NO: 2252 - RNA, 18 nt, Artificial Sequence
  Description of Artificial Sequence: Synthetic oligonucleotide
gguugcccccagcccaca

SEQ ID NO: 2253 - RNA, 18 nt, Artificial Sequence
  Description of Artificial Sequence: Synthetic oligonucleotide
agaaggguugcccccagc

SEQ ID NO: 2254 - RNA, 18 nt, Artificial Sequence
  Description of Artificial Sequence: Synthetic oligonucleotide
uguacagaaggguugccc

SEQ ID NO: 2255 - RNA, 18 nt, Artificial Sequence
  Description of Artificial Sequence: Synthetic oligonucleotide
agcucuguacagaagggu

SEQ ID NO: 2256 - RNA, 18 nt, Artificial Sequence
  Description of Artificial Sequence: Synthetic oligonucleotide
caggaagcucuguacaga

SEQ ID NO: 2257 - RNA, 18 nt, Artificial Sequence
  Description of Artificial Sequence: Synthetic oligonucleotide
gggccaggaagcucugua

SEQ ID NO: 2258 - RNA, 18 nt, Artificial Sequence
  Description of Artificial Sequence: Synthetic oligonucleotide
cuugaggugguggguggg

SEQ ID NO: 2259 - RNA, 18 nt, Artificial Sequence
  Description of Artificial Sequence: Synthetic oligonucleotide
cuacccuugagguggugg

SEQ ID NO: 2260 - RNA, 18 nt, Artificial Sequence
  Description of Artificial Sequence: Synthetic oligonucleotide
acucccuacccuugaggu

SEQ ID NO: 2261 - RNA, 18 nt, Artificial Sequence
  Description of Artificial Sequence: Synthetic oligonucleotide
gagcaacucccuacccuu

SEQ ID NO: 2262 - RNA, 18 nt, Artificial Sequence
  Description of Artificial Sequence: Synthetic oligonucleotide
aggaagagcaacucccua

SEQ ID NO: 2263 - RNA, 18 nt, Artificial Sequence
  Description of Artificial Sequence: Synthetic oligonucleotide
cagguaggaagagcaacu

SEQ ID NO: 2264 - RNA, 18 nt, Artificial Sequence
  Description of Artificial Sequence: Synthetic oligonucleotide
uaaaacagguaggaagag

SEQ ID NO: 2265 - RNA, 18 nt, Artificial Sequence
  Description of Artificial Sequence: Synthetic oligonucleotide
caaaauaaaacagguagg

SEQ ID NO: 2266 - RNA, 18 nt, Artificial Sequence
  Description of Artificial Sequence: Synthetic oligonucleotide
gaaaacaaaauaaaacag

SEQ ID NO: 2267 - RNA, 18 nt, Artificial Sequence
  Description of Artificial Sequence: Synthetic oligonucleotide
aacgagaaaacaaaauaa

SEQ ID NO: 2268 - RNA, 18 nt, Artificial Sequence
  Description of Artificial Sequence: Synthetic oligonucleotide
gggagaacgagaaaacaa

SEQ ID NO: 2269 - RNA, 18 nt, Artificial Sequence
  Description of Artificial Sequence: Synthetic oligonucleotide
gggagggagaacgagaaa

SEQ ID NO: 2270 - RNA, 18 nt, Artificial Sequence
  Description of Artificial Sequence: Synthetic oligonucleotide
gauaaggcugggaguggg

SEQ ID NO: 2271 - RNA, 18 nt, Artificial Sequence
  Description of Artificial Sequence: Synthetic oligonucleotide
ggauagauaaggcuggga

SEQ ID NO: 2272 - RNA, 18 nt, Artificial Sequence
  Description of Artificial Sequence: Synthetic oligonucleotide
gggauagauaaggcuggg

SEQ ID NO: 2273 - RNA, 18 nt, Artificial Sequence
  Description of Artificial Sequence: Synthetic oligonucleotide
ugggaguggagaaaaggg

SEQ ID NO: 2274 - RNA, 18 nt, Artificial Sequence
  Description of Artificial Sequence: Synthetic oligonucleotide
gggcugggaguggagaaa

SEQ ID NO: 2275 - RNA, 18 nt, Artificial Sequence
  Description of Artificial Sequence: Synthetic oligonucleotide
agaaaaaaaggaaauggg

SEQ ID NO: 2276 - RNA, 18 nt, Artificial Sequence
  Description of Artificial Sequence: Synthetic oligonucleotide
acuccagaaaaaaaggaa

SEQ ID NO: 2277 - RNA, 18 nt, Artificial Sequence
  Description of Artificial Sequence: Synthetic oligonucleotide
cacacacuccagaaaaaa

SEQ ID NO: 2278 - RNA, 18 nt, Artificial Sequence
  Description of Artificial Sequence: Synthetic oligonucleotide
uucaccacacacuccaga

SEQ ID NO: 2279 - RNA, 18 nt, Artificial Sequence
  Description of Artificial Sequence: Synthetic oligonucleotide
ucuguuucaccacacacu

SEQ ID NO: 2280 - RNA, 18 nt, Artificial Sequence
  Description of Artificial Sequence: Synthetic oligonucleotide
uuuuuucuguuucaccac

SEQ ID NO: 2281 - RNA, 18 nt, Artificial Sequence
  Description of Artificial Sequence: Synthetic oligonucleotide
cauguuuuuuucuguuuc

SEQ ID NO: 2282 - RNA, 18 nt, Artificial Sequence
  Description of Artificial Sequence: Synthetic oligonucleotide
uuaaacauguuuuuuucu

SEQ ID NO: 2283 - RNA, 18 nt, Artificial Sequence
  Description of Artificial Sequence: Synthetic oligonucleotide
guuuauuaaacauguuuu

SEQ ID NO: 2284 - RNA, 18 nt, Artificial Sequence
  Description of Artificial Sequence: Synthetic oligonucleotide
ucuccguuuauuaaacau

SEQ ID NO: 2285 - RNA, 18 nt, Artificial Sequence
  Description of Artificial Sequence: Synthetic oligonucleotide
aacaaucuccguuuauua

SEQ ID NO: 2286 - RNA, 18 nt, Artificial Sequence
  Description of Artificial Sequence: Synthetic oligonucleotide
aaaagaacaaucuccguu

SEQ ID NO: 2287 - RNA, 18 nt, Artificial Sequence
  Description of Artificial Sequence: Synthetic oligonucleotide
gcgagccauguccauaga

SEQ ID NO: 2288 - RNA, 18 nt, Artificial Sequence
  Description of Artificial Sequence: Synthetic oligonucleotide
gggaggcgagccaugucc

SEQ ID NO: 2289 - RNA, 18 nt, Artificial Sequence
  Description of Artificial Sequence: Synthetic oligonucleotide
ggcuuuuccuugguuggg

SEQ ID NO: 2290 - RNA, 18 nt, Artificial Sequence
  Description of Artificial Sequence: Synthetic oligonucleotide
ggguggcuuuuccuuggu

SEQ ID NO: 2291 - RNA, 18 nt, Artificial Sequence
  Description of Artificial Sequence: Synthetic oligonucleotide
ccaccaggcggugguggg

SEQ ID NO: 2292 - RNA, 18 nt, Artificial Sequence
  Description of Artificial Sequence: Synthetic oligonucleotide
accaccaccaggcggugg

SEQ ID NO: 2293 - RNA, 18 nt, Artificial Sequence
  Description of Artificial Sequence: Synthetic oligonucleotide
ucuuuaccaccaccaggc

SEQ ID NO: 2294 - RNA, 18 nt, Artificial Sequence
  Description of Artificial Sequence: Synthetic oligonucleotide
acaggucuuuaccaccac

SEQ ID NO: 2295 - RNA, 18 nt, Artificial Sequence
  Description of Artificial Sequence: Synthetic oligonucleotide
auagaacaggucuuuacc

SEQ ID NO: 2296 - RNA, 18 nt, Artificial Sequence
  Description of Artificial Sequence: Synthetic oligonucleotide
cuuacauagaacaggucu

SEQ ID NO: 2297 - RNA, 18 nt, Artificial Sequence
  Description of Artificial Sequence: Synthetic oligonucleotide
gacggcuuacauagaaca

SEQ ID NO: 2298 - RNA, 18 nt, Artificial Sequence
  Description of Artificial Sequence: Synthetic oligonucleotide
ggguggacggcuuacaua

SEQ ID NO: 2299 - RNA, 18 nt, Artificial Sequence
  Description of Artificial Sequence: Synthetic oligonucleotide
gugaggaacgggccaggg

SEQ ID NO: 2300 - RNA, 18 nt, Artificial Sequence
  Description of Artificial Sequence: Synthetic oligonucleotide
ggugaggaacgggccagg

SEQ ID NO: 2301 - RNA, 18 nt, Artificial Sequence
  Description of Artificial Sequence: Synthetic oligonucleotide
augcuggugaggaacggg

SEQ ID NO: 2302 - RNA, 18 nt, Artificial Sequence
  Description of Artificial Sequence: Synthetic oligonucleotide
gcaguaugcuggugagga

SEQ ID NO: 2303 - RNA, 18 nt, Artificial Sequence
  Description of Artificial Sequence: Synthetic oligonucleotide
cucgugcaguaugcuggu

SEQ ID NO: 2304 - RNA, 18 nt, Artificial Sequence
  Description of Artificial Sequence: Synthetic oligonucleotide
agcugcucgugcaguaug

SEQ ID NO: 2305 - RNA, 18 nt, Artificial Sequence
  Description of Artificial Sequence: Synthetic oligonucleotide
guccgagcugcucgugca

SEQ ID NO: 2306 - RNA, 18 nt, Artificial Sequence
  Description of Artificial Sequence: Synthetic oligonucleotide
gugauguccgagcugcuc

SEQ ID NO: 2307 - RNA, 18 nt, Artificial Sequence
  Description of Artificial Sequence: Synthetic oligonucleotide
gcucugugauguccgagc

SEQ ID NO: 2308 - RNA, 18 nt, Artificial Sequence
  Description of Artificial Sequence: Synthetic oligonucleotide
cucuggcucugugauguc

SEQ ID NO: 2309 - RNA, 18 nt, Artificial Sequence
  Description of Artificial Sequence: Synthetic oligonucleotide
uucugcucuggcucugug

SEQ ID NO: 2310 - RNA, 18 nt, Artificial Sequence
  Description of Artificial Sequence: Synthetic oligonucleotide
gcaucuucugcucuggcu

SEQ ID NO: 2311 - RNA, 18 nt, Artificial Sequence
  Description of Artificial Sequence: Synthetic oligonucleotide
acucagcaucuucugcuc

SEQ ID NO: 2312 - RNA, 18 nt, Artificial Sequence
  Description of Artificial Sequence: Synthetic oligonucleotide
uugacacucagcaucuuc

SEQ ID NO: 2313 - RNA, 18 nt, Artificial Sequence
  Description of Artificial Sequence: Synthetic oligonucleotide
ucuuguugacacucagca

SEQ ID NO: 2314 - RNA, 18 nt, Artificial Sequence
  Description of Artificial Sequence: Synthetic oligonucleotide
cacacucuuguugacacu

SEQ ID NO: 2315 - RNA, 18 nt, Artificial Sequence
  Description of Artificial Sequence: Synthetic oligonucleotide
auggacacacucuuguug

SEQ ID NO: 2316 - RNA, 18 nt, Artificial Sequence
  Description of Artificial Sequence: Synthetic oligonucleotide
ccagcauggacacacucu

SEQ ID NO: 2317 - RNA, 18 nt, Artificial Sequence
  Description of Artificial Sequence: Synthetic oligonucleotide
uaaguccagcauggacac

SEQ ID NO: 2318 - RNA, 18 nt, Artificial Sequence
  Description of Artificial Sequence: Synthetic oligonucleotide
cccuguaaguccagcaug

SEQ ID NO: 2319 - RNA, 18 nt, Artificial Sequence
  Description of Artificial Sequence: Synthetic oligonucleotide
caucacccuguaagucca

SEQ ID NO: 2320 - RNA, 18 nt, Artificial Sequence
  Description of Artificial Sequence: Synthetic oligonucleotide
aggcccaucacccuguaa

SEQ ID NO: 2321 - RNA, 18 nt, Artificial Sequence
  Description of Artificial Sequence: Synthetic oligonucleotide
ccaccaggcccaucaccc

SEQ ID NO: 2322 - RNA, 18 nt, Artificial Sequence
  Description of Artificial Sequence: Synthetic oligonucleotide
ggcggccaccaggcccau

SEQ ID NO: 2323 - RNA, 18 nt, Artificial Sequence
  Description of Artificial Sequence: Synthetic oligonucleotide
guugaggcggccaccagg

SEQ ID NO: 2324 - RNA, 18 nt, Artificial Sequence
  Description of Artificial Sequence: Synthetic oligonucleotide
cugcuguugaggcggcca

SEQ ID NO: 2325 - RNA, 18 nt, Artificial Sequence
  Description of Artificial Sequence: Synthetic oligonucleotide
cacugcugcuguugaggc

SEQ ID NO: 2326 - RNA, 18 nt, Artificial Sequence
  Description of Artificial Sequence: Synthetic oligonucleotide
cgaaacacugcugcuguu

SEQ ID NO: 2327 - RNA, 18 nt, Artificial Sequence
  Description of Artificial Sequence: Synthetic oligonucleotide
agguucgaaacacugcug

SEQ ID NO: 2328 - RNA, 18 nt, Artificial Sequence
  Description of Artificial Sequence: Synthetic oligonucleotide
ccgccagguucgaaacac

SEQ ID NO: 2329 - RNA, 18 nt, Artificial Sequence
  Description of Artificial Sequence: Synthetic oligonucleotide
uacggccgccagguucga

SEQ ID NO: 2330 - RNA, 18 nt, Artificial Sequence
  Description of Artificial Sequence: Synthetic oligonucleotide
uccccuacggccgccagg

SEQ ID NO: 2331 - RNA, 18 nt, Artificial Sequence
  Description of Artificial Sequence: Synthetic oligonucleotide
gcagguccccuacggccg

SEQ ID NO: 2332 - RNA, 18 nt, Artificial Sequence
  Description of Artificial Sequence: Synthetic oligonucleotide
gugcagcagguccccuac

SEQ ID NO: 2333 - RNA, 18 nt, Artificial Sequence
  Description of Artificial Sequence: Synthetic oligonucleotide
cuugagugcagcaggucc

SEQ ID NO: 2334 - RNA, 18 nt, Artificial Sequence
  Description of Artificial Sequence: Synthetic oligonucleotide
ccuggcuugagugcagca

SEQ ID NO: 2335 - RNA, 18 nt, Artificial Sequence
  Description of Artificial Sequence: Synthetic oligonucleotide
cgaggccuggcuugagug

SEQ ID NO: 2336 - RNA, 18 nt, Artificial Sequence
  Description of Artificial Sequence: Synthetic oligonucleotide
gucagcgaggccuggcuu

SEQ ID NO: 2337 - RNA, 18 nt, Artificial Sequence
  Description of Artificial Sequence: Synthetic oligonucleotide
cugcugucagcgaggccu

SEQ ID NO: 2338 - RNA, 18 nt, Artificial Sequence
  Description of Artificial Sequence: Synthetic oligonucleotide
caaggcugcugucagcga

SEQ ID NO: 2339 - RNA, 18 nt, Artificial Sequence
  Description of Artificial Sequence: Synthetic oligonucleotide
agccccaaggcugcuguc

SEQ ID NO: 2340 - RNA, 18 nt, Artificial Sequence
  Description of Artificial Sequence: Synthetic oligonucleotide
gccguagccccaaggcug

SEQ ID NO: 2341 - RNA, 18 nt, Artificial Sequence
  Description of Artificial Sequence: Synthetic oligonucleotide
cgcaggccguagccccaa

SEQ ID NO: 2342 - RNA, 18 nt, Artificial Sequence
  Description of Artificial Sequence: Synthetic oligonucleotide
gcaggcgcaggccguagc

SEQ ID NO: 2343 - RNA, 18 nt, Artificial Sequence
  Description of Artificial Sequence: Synthetic oligonucleotide
guccggcaggcgcaggcc

SEQ ID NO: 2344 - RNA, 18 nt, Artificial Sequence
  Description of Artificial Sequence: Synthetic oligonucleotide
gaggcguccggcaggcgc

SEQ ID NO: 2345 - RNA, 18 nt, Artificial Sequence
  Description of Artificial Sequence: Synthetic oligonucleotide
ugggagaggcguccggca

SEQ ID NO: 2346 - RNA, 18 nt, Artificial Sequence
  Description of Artificial Sequence: Synthetic oligonucleotide
uccccugggagaggcguc

SEQ ID NO: 2347 - RNA, 18 nt, Artificial Sequence
  Description of Artificial Sequence: Synthetic oligonucleotide
gccacuccccugggagag

SEQ ID NO: 2348 - RNA, 18 nt, Artificial Sequence
  Description of Artificial Sequence: Synthetic oligonucleotide
gaugagccacuccccugg

SEQ ID NO: 2349 - RNA, 18 nt, Artificial Sequence
  Description of Artificial Sequence: Synthetic oligonucleotide
ugauggaugagccacucc

SEQ ID NO: 2350 - RNA, 18 nt, Artificial Sequence
  Description of Artificial Sequence: Synthetic oligonucleotide
cgccgugauggaugagcc

SEQ ID NO: 2351 - RNA, 18 nt, Artificial Sequence
  Description of Artificial Sequence: Synthetic oligonucleotide
ccagccgccgugauggau

SEQ ID NO: 2352 - RNA, 18 nt, Artificial Sequence
  Description of Artificial Sequence: Synthetic oligonucleotide
gcaugccagccgccguga

SEQ ID NO: 2353 - RNA, 18 nt, Artificial Sequence
  Description of Artificial Sequence: Synthetic oligonucleotide
gaggcgcaugccagccgc

SEQ ID NO: 2354 - RNA, 18 nt, Artificial Sequence
  Description of Artificial Sequence: Synthetic oligonucleotide
uggcugaggcgcaugcca

SEQ ID NO: 2355 - RNA, 18 nt, Artificial Sequence
  Description of Artificial Sequence: Synthetic oligonucleotide
ccaucuggcugaggcgca

SEQ ID NO: 2356 - RNA, 18 nt, Artificial Sequence
  Description of Artificial Sequence: Synthetic oligonucleotide
gacacccaucuggcugag

SEQ ID NO: 2357 - RNA, 18 nt, Artificial Sequence
  Description of Artificial Sequence: Synthetic oligonucleotide
guggugacacccaucugg

SEQ ID NO: 2358 - RNA, 18 nt, Artificial Sequence
  Description of Artificial Sequence: Synthetic oligonucleotide
cgucuguggugacaccca

SEQ ID NO: 2359 - RNA, 18 nt, Artificial Sequence
  Description of Artificial Sequence: Synthetic oligonucleotide
gacaccgucuguggugac

SEQ ID NO: 2360 - RNA, 18 nt, Artificial Sequence
  Description of Artificial Sequence: Synthetic oligonucleotide
gcagggacaccgucugug

SEQ ID NO: 2361 - RNA, 18 nt, Artificial Sequence
  Description of Artificial Sequence: Synthetic oligonucleotide
gcugggcagggacaccgu

SEQ ID NO: 2362 - RNA, 18 nt, Artificial Sequence
  Description of Artificial Sequence: Synthetic oligonucleotide
caguugcugggcagggac

SEQ ID NO: 2363 - RNA, 18 nt, Artificial Sequence
  Description of Artificial Sequence: Synthetic oligonucleotide
auucgcaguugcugggca

SEQ ID NO: 2364 - RNA, 18 nt, Artificial Sequence
  Description of Artificial Sequence: Synthetic oligonucleotide
gguucuggaaggagaggg

SEQ ID NO: 2365 - RNA, 18 nt, Artificial Sequence
  Description of Artificial Sequence: Synthetic oligonucleotide
gagaggguucuggaagga

SEQ ID NO: 2366 - RNA, 18 nt, Artificial Sequence
  Description of Artificial Sequence: Synthetic oligonucleotide
uggaagagaggguucugg

SEQ ID NO: 2367 - RNA, 18 nt, Artificial Sequence
  Description of Artificial Sequence: Synthetic oligonucleotide
ccauguggaagagagggu

SEQ ID NO: 2368 - RNA, 18 nt, Artificial Sequence
  Description of Artificial Sequence: Synthetic oligonucleotide
agcagccauguggaagag

SEQ ID NO: 2369 - RNA, 18 nt, Artificial Sequence
  Description of Artificial Sequence: Synthetic oligonucleotide
ccaucagcagccaugugg

SEQ ID NO: 2370 - RNA, 18 nt, Artificial Sequence
  Description of Artificial Sequence: Synthetic oligonucleotide
cuggcccaucagcagcca

SEQ ID NO: 2371 - RNA, 18 nt, Artificial Sequence
  Description of Artificial Sequence: Synthetic oligonucleotide
gggaccuggcccaucagc

SEQ ID NO: 2372 - RNA, 18 nt, Artificial Sequence
  Description of Artificial Sequence: Synthetic oligonucleotide
ccuccauggccgccuggg

SEQ ID NO: 2373 - RNA, 18 nt, Artificial Sequence
  Description of Artificial Sequence: Synthetic oligonucleotide
cccccuccauggccgccu

SEQ ID NO: 2374 - RNA, 18 nt, Artificial Sequence
  Description of Artificial Sequence: Synthetic oligonucleotide
caccgcccccuccauggc

SEQ ID NO: 2375 - RNA, 18 nt, Artificial Sequence
  Description of Artificial Sequence: Synthetic oligonucleotide
auggccaccgcccccucc

SEQ ID NO: 2376 - RNA, 18 nt, Artificial Sequence
  Description of Artificial Sequence: Synthetic oligonucleotide
gggccauggccaccgccc

SEQ ID NO: 2377 - RNA, 18 nt, Artificial Sequence
  Description of Artificial Sequence: Synthetic oligonucleotide
aaggugggccauggccac

SEQ ID NO: 2378 - RNA, 18 nt, Artificial Sequence
  Description of Artificial Sequence: Synthetic oligonucleotide
ggaggaaggugggccaug

SEQ ID NO: 2379 - RNA, 18 nt, Artificial Sequence
  Description of Artificial Sequence: Synthetic oligonucleotide
ugaugggaggaagguggg

SEQ ID NO: 2380 - RNA, 18 nt, Artificial Sequence
  Description of Artificial Sequence: Synthetic oligonucleotide
gguggugaugggaggaag

SEQ ID NO: 2381 - RNA, 18 nt, Artificial Sequence
  Description of Artificial Sequence: Synthetic oligonucleotide
guggugguggugauggga

SEQ ID NO: 2382 - RNA, 18 nt, Artificial Sequence
  Description of Artificial Sequence: Synthetic oligonucleotide
ugguggugguggugguga

SEQ ID NO: 2383 - RNA, 18 nt, Artificial Sequence
  Description of Artificial Sequence: Synthetic oligonucleotide
ggugaugguggugguggu

SEQ ID NO: 2384 - RNA, 18 nt, Artificial Sequence
  Description of Artificial Sequence: Synthetic oligonucleotide
gugguggugaugguggug

SEQ ID NO: 2385 - RNA, 18 nt, Artificial Sequence
  Description of Artificial Sequence: Synthetic oligonucleotide
ccucggugguggugaugg

SEQ ID NO: 2386 - RNA, 18 nt, Artificial Sequence
  Description of Artificial Sequence: Synthetic oligonucleotide
cuccaccucggugguggu

SEQ ID NO: 2387 - RNA, 18 nt, Artificial Sequence
  Description of Artificial Sequence: Synthetic oligonucleotide
gggcucuccaccucggug

SEQ ID NO: 2388 - RNA, 18 nt, Artificial Sequence
  Description of Artificial Sequence: Synthetic oligonucleotide
gcaaagguguccccaggg

SEQ ID NO: 2389 - RNA, 18 nt, Artificial Sequence
  Description of Artificial Sequence: Synthetic oligonucleotide
cuauagccauggaauggg

SEQ ID NO: 2390 - RNA, 18 nt, Artificial Sequence
  Description of Artificial Sequence: Synthetic oligonucleotide
ucuugcuauagccaugga

SEQ ID NO: 2391 - RNA, 18 nt, Artificial Sequence
  Description of Artificial Sequence: Synthetic oligonucleotide
cucacucuugcuauagcc

SEQ ID NO: 2392 - RNA, 18 nt, Artificial Sequence
  Description of Artificial Sequence: Synthetic oligonucleotide
agguccucacucuugcua

SEQ ID NO: 2393 - RNA, 18 nt, Artificial Sequence
  Description of Artificial Sequence: Synthetic oligonucleotide
aagagagguccucacucu

SEQ ID NO: 2394 - RNA, 18 nt, Artificial Sequence
  Description of Artificial Sequence: Synthetic oligonucleotide
cccggaagagagguccuc

SEQ ID NO: 2395 - RNA, 18 nt, Artificial Sequence
  Description of Artificial Sequence: Synthetic oligonucleotide
gggaccccggaagagagg

SEQ ID NO: 2396 - RNA, 18 nt, Artificial Sequence
  Description of Artificial Sequence: Synthetic oligonucleotide
aggauggaggcagcaggg

SEQ ID NO: 2397 - RNA, 18 nt, Artificial Sequence
  Description of Artificial Sequence: Synthetic oligonucleotide
ugaaggauggaggcagca

SEQ ID NO: 2398 - RNA, 18 nt, Artificial Sequence
  Description of Artificial Sequence: Synthetic oligonucleotide
ggcuaugaaggauggagg

SEQ ID NO: 2399 - RNA, 18 nt, Artificial Sequence
  Description of Artificial Sequence: Synthetic oligonucleotide
gcuguggcuaugaaggau

SEQ ID NO: 2400 - RNA, 18 nt, Artificial Sequence
  Description of Artificial Sequence: Synthetic oligonucleotide
cuguagcuguggcuauga

SEQ ID NO: 2401 - RNA, 18 nt, Artificial Sequence
  Description of Artificial Sequence: Synthetic oligonucleotide
caucacuguagcuguggc

SEQ ID NO: 2402 - RNA, 18 nt, Artificial Sequence
  Description of Artificial Sequence: Synthetic oligonucleotide
aaacucaucacuguagcu

SEQ ID NO: 2403 - RNA, 18 nt, Artificial Sequence
  Description of Artificial Sequence: Synthetic oligonucleotide
gguccaaacucaucacug

SEQ ID NO: 2404 - RNA, 18 nt, Artificial Sequence
  Description of Artificial Sequence: Synthetic oligonucleotide
cagaggguccaaacucau

SEQ ID NO: 2405 - RNA, 18 nt, Artificial Sequence
  Description of Artificial Sequence: Synthetic oligonucleotide
agugccagaggguccaaa

SEQ ID NO: 2406 - RNA, 18 nt, Artificial Sequence
  Description of Artificial Sequence: Synthetic oligonucleotide
aagucagugccagagggu

SEQ ID NO: 2407 - RNA, 18 nt, Artificial Sequence
  Description of Artificial Sequence: Synthetic oligonucleotide
gggugaagucagugccag

SEQ ID NO: 2408 - RNA, 18 nt, Artificial Sequence
  Description of Artificial Sequence: Synthetic oligonucleotide
ccgacgggugaagucagu

SEQ ID NO: 2409 - RNA, 18 nt, Artificial Sequence
  Description of Artificial Sequence: Synthetic oligonucleotide
agcugccgacgggugaag

SEQ ID NO: 2410 - RNA, 18 nt, Artificial Sequence
  Description of Artificial Sequence: Synthetic oligonucleotide
gugaaagcugccgacggg

SEQ ID NO: 2411 - RNA, 18 nt, Artificial Sequence
  Description of Artificial Sequence: Synthetic oligonucleotide
cuggagugaaagcugccg

SEQ ID NO: 2412 - RNA, 18 nt, Artificial Sequence
  Description of Artificial Sequence: Synthetic oligonucleotide
uuguccuggagugaaagc

SEQ ID NO: 2413 - RNA, 18 nt, Artificial Sequence
  Description of Artificial Sequence: Synthetic oligonucleotide
gcagguuguccuggagug

SEQ ID NO: 2414 - RNA, 18 nt, Artificial Sequence
  Description of Artificial Sequence: Synthetic oligonucleotide
gugcugcagguuguccug

SEQ ID NO: 2415 - RNA, 18 nt, Artificial Sequence
  Description of Artificial Sequence: Synthetic oligonucleotide
agcaugugcugcagguug

SEQ ID NO: 2416 - RNA, 18 nt, Artificial Sequence
  Description of Artificial Sequence: Synthetic oligonucleotide
gggacagcaugugcugca

SEQ ID NO: 2417 - RNA, 18 nt, Artificial Sequence
  Description of Artificial Sequence: Synthetic oligonucleotide
gaccaauggugaucuggg

SEQ ID NO: 2418 - RNA, 18 nt, Artificial Sequence
  Description of Artificial Sequence: Synthetic oligonucleotide
gggaccaauggugaucug

SEQ ID NO: 2419 - RNA, 18 nt, Artificial Sequence
  Description of Artificial Sequence: Synthetic oligonucleotide
accuccaggcccugaggg

SEQ ID NO: 2420 - RNA, 18 nt, Artificial Sequence
  Description of Artificial Sequence: Synthetic oligonucleotide
cucccaccuccaggcccu

SEQ ID NO: 2421 - RNA, 18 nt, Artificial Sequence
  Description of Artificial Sequence: Synthetic oligonucleotide
caccgcucccaccuccag

SEQ ID NO: 2422 - RNA, 18 nt, Artificial Sequence
  Description of Artificial Sequence: Synthetic oligonucleotide
gcccccaccgcucccacc

SEQ ID NO: 2423 - RNA, 18 nt, Artificial Sequence
  Description of Artificial Sequence: Synthetic oligonucleotide
ccgcugcccccaccgcuc

SEQ ID NO: 2424 - RNA, 18 nt, Artificial Sequence
  Description of Artificial Sequence: Synthetic oligonucleotide
ccccaccgcugcccccac

SEQ ID NO: 2425 - RNA, 18 nt, Artificial Sequence
  Description of Artificial Sequence: Synthetic oligonucleotide
gccacccccaccgcugcc

SEQ ID NO: 2426 - RNA, 18 nt, Artificial Sequence
  Description of Artificial Sequence: Synthetic oligonucleotide
cccccgccacccccaccg

SEQ ID NO: 2427 - RNA, 18 nt, Artificial Sequence
  Description of Artificial Sequence: Synthetic oligonucleotide
gcuggcccccgccacccc

SEQ ID NO: 2428 - RNA, 18 nt, Artificial Sequence
  Description of Artificial Sequence: Synthetic oligonucleotide
aggcggcuggcccccgcc

SEQ ID NO: 2429 - RNA, 18 nt, Artificial Sequence
  Description of Artificial Sequence: Synthetic oligonucleotide
aauggaggcggcuggccc

SEQ ID NO: 2430 - RNA, 18 nt, Artificial Sequence
  Description of Artificial Sequence: Synthetic oligonucleotide
ucugcaauggaggcggcu

SEQ ID NO: 2431 - RNA, 18 nt, Artificial Sequence
  Description of Artificial Sequence: Synthetic oligonucleotide
gccccucugcaauggagg

SEQ ID NO: 2432 - RNA, 18 nt, Artificial Sequence
  Description of Artificial Sequence: Synthetic oligonucleotide
gacuugccccucugcaau

SEQ ID NO: 2433 - RNA, 18 nt, Artificial Sequence
  Description of Artificial Sequence: Synthetic oligonucleotide
gcugagacuugccccucu

SEQ ID NO: 2434 - RNA, 18 nt, Artificial Sequence
  Description of Artificial Sequence: Synthetic oligonucleotide
caacugcugagacuugcc

SEQ ID NO: 2435 - RNA, 18 nt, Artificial Sequence
  Description of Artificial Sequence: Synthetic oligonucleotide
acugucaacugcugagac

SEQ ID NO: 2436 - RNA, 18 nt, Artificial Sequence
  Description of Artificial Sequence: Synthetic oligonucleotide
cgcugacugucaacugcu

SEQ ID NO: 2437 - RNA, 18 nt, Artificial Sequence
  Description of Artificial Sequence: Synthetic oligonucleotide
ggcugcgcugacugucaa

SEQ ID NO: 2438 - RNA, 18 nt, Artificial Sequence
  Description of Artificial Sequence: Synthetic oligonucleotide
uucugggcugcgcugacu

SEQ ID NO: 2439 - RNA, 18 nt, Artificial Sequence
  Description of Artificial Sequence: Synthetic oligonucleotide
ucccgcuggauggccggg

SEQ ID NO: 2440 - RNA, 18 nt, Artificial Sequence
  Description of Artificial Sequence: Synthetic oligonucleotide
uagauucccgcuggaugg

SEQ ID NO: 2441 - RNA, 18 nt, Artificial Sequence
  Description of Artificial Sequence: Synthetic oligonucleotide
ugcaauagauucccgcug

SEQ ID NO: 2442 - RNA, 18 nt, Artificial Sequence
  Description of Artificial Sequence: Synthetic oligonucleotide
gggacugcaauagauucc

SEQ ID NO: 2443 - RNA, 18 nt, Artificial Sequence
  Description of Artificial Sequence: Synthetic oligonucleotide
ccauaacuuggcucuggg

SEQ ID NO: 2444 - RNA, 18 nt, Artificial Sequence
  Description of Artificial Sequence: Synthetic oligonucleotide
gggccauaacuuggcucu

SEQ ID NO: 2445 - RNA, 18 nt, Artificial Sequence
  Description of Artificial Sequence: Synthetic oligonucleotide
uugccguggacgggcggg

SEQ ID NO: 2446 - RNA, 18 nt, Artificial Sequence
  Description of Artificial Sequence: Synthetic oligonucleotide
uguugccguggacgggcg

SEQ ID NO: 2447 - RNA, 18 nt, Artificial Sequence
  Description of Artificial Sequence: Synthetic oligonucleotide
ggcucuguugccguggac

SEQ ID NO: 2448 - RNA, 18 nt, Artificial Sequence
  Description of Artificial Sequence: Synthetic oligonucleotide
gcugaggcucuguugccg

SEQ ID NO: 2449 - RNA, 18 nt, Artificial Sequence
  Description of Artificial Sequence: Synthetic oligonucleotide
uccuugcugaggcucugu

SEQ ID NO: 2450 - RNA, 18 nt, Artificial Sequence
  Description of Artificial Sequence: Synthetic oligonucleotide
ugcccuccuugcugaggc

SEQ ID NO: 2451 - RNA, 18 nt, Artificial Sequence
  Description of Artificial Sequence: Synthetic oligonucleotide
aaugcugcccuccuugcu

SEQ ID NO: 2452 - RNA, 18 nt, Artificial Sequence
  Description of Artificial Sequence: Synthetic oligonucleotide
cccccaaugcugcccucc

SEQ ID NO: 2453 - RNA, 18 nt, Artificial Sequence
  Description of Artificial Sequence: Synthetic oligonucleotide
cgcugcccccaaugcugc

SEQ ID NO: 2454 - RNA, 18 nt, Artificial Sequence
  Description of Artificial Sequence: Synthetic oligonucleotide
gcccccgcugcccccaau

SEQ ID NO: 2455 - RNA, 18 nt, Artificial Sequence
  Description of Artificial Sequence: Synthetic oligonucleotide
ccgcugcccccgcugccc

SEQ ID NO: 2456 - RNA, 18 nt, Artificial Sequence
  Description of Artificial Sequence: Synthetic oligonucleotide
cgccaccgcugcccccgc

SEQ ID NO: 2457 - RNA, 18 nt, Artificial Sequence
  Description of Artificial Sequence: Synthetic oligonucleotide
cccuccgccaccgcugcc

SEQ ID NO: 2458 - RNA, 18 nt, Artificial Sequence
  Description of Artificial Sequence: Synthetic oligonucleotide
ccacccccuccgccaccg

SEQ ID NO: 2459 - RNA, 18 nt, Artificial Sequence
  Description of Artificial Sequence: Synthetic oligonucleotide
gccccccacccccuccgc

SEQ ID NO: 2460 - RNA, 18 nt, Artificial Sequence
  Description of Artificial Sequence: Synthetic oligonucleotide
cuucagccccccaccccc

SEQ ID NO: 2461 - RNA, 18 nt, Artificial Sequence
  Description of Artificial Sequence: Synthetic oligonucleotide
gagggcuucagcccccca

SEQ ID NO: 2462 - RNA, 18 nt, Artificial Sequence
  Description of Artificial Sequence: Synthetic oligonucleotide
ugauggagggcuucagcc

SEQ ID NO: 2463 - RNA, 18 nt, Artificial Sequence
  Description of Artificial Sequence: Synthetic oligonucleotide
cuuggugauggagggcuu

SEQ ID NO: 2464 - RNA, 18 nt, Artificial Sequence
  Description of Artificial Sequence: Synthetic oligonucleotide
gccuuccuccugccuuca

SEQ ID NO: 2465 - RNA, 18 nt, Artificial Sequence
  Description of Artificial Sequence: Synthetic oligonucleotide
agcccgccuuccuccugc

SEQ ID NO: 2466 - RNA, 18 nt, Artificial Sequence
  Description of Artificial Sequence: Synthetic oligonucleotide
gacccagcccgccuuccu

SEQ ID NO: 2467 - RNA, 18 nt, Artificial Sequence
  Description of Artificial Sequence: Synthetic oligonucleotide
guugugacccagcccgcc

SEQ ID NO: 2468 - RNA, 18 nt, Artificial Sequence
  Description of Artificial Sequence: Synthetic oligonucleotide
ucccuguugugacccagc

SEQ ID NO: 2469 - RNA, 18 nt, Artificial Sequence
  Description of Artificial Sequence: Synthetic oligonucleotide
uucccucccuguugugac

SEQ ID NO: 2470 - RNA, 18 nt, Artificial Sequence
  Description of Artificial Sequence: Synthetic oligonucleotide
ccuucuucccucccuguu

SEQ ID NO: 2471 - RNA, 18 nt, Artificial Sequence
  Description of Artificial Sequence: Synthetic oligonucleotide
caucuccuucuucccucc

SEQ ID NO: 2472 - RNA, 18 nt, Artificial Sequence
  Description of Artificial Sequence: Synthetic oligonucleotide
ccccccaucuccuucuuc

SEQ ID NO: 2473 - RNA, 18 nt, Artificial Sequence
  Description of Artificial Sequence: Synthetic oligonucleotide
ccccaccccccaucuccu

SEQ ID NO: 2474 - RNA, 18 nt, Artificial Sequence
  Description of Artificial Sequence: Synthetic oligonucleotide
uucaaccccaccccccau

SEQ ID NO: 2475 - RNA, 18 nt, Artificial Sequence
  Description of Artificial Sequence: Synthetic oligonucleotide
ucuguuucaaccccaccc

SEQ ID NO: 2476 - RNA, 18 nt, Artificial Sequence
  Description of Artificial Sequence: Synthetic oligonucleotide
cagacucuguuucaaccc

SEQ ID NO: 2477 - RNA, 18 nt, Artificial Sequence
  Description of Artificial Sequence: Synthetic oligonucleotide
ggccacagacucuguuuc

SEQ ID NO: 2478 - RNA, 18 nt, Artificial Sequence
  Description of Artificial Sequence: Synthetic oligonucleotide
cuucaggccacagacucu

SEQ ID NO: 2479 - RNA, 18 nt, Artificial Sequence
  Description of Artificial Sequence: Synthetic oligonucleotide
uguaacuucaggccacag

SEQ ID NO: 2480 - RNA, 18 nt, Artificial Sequence
  Description of Artificial Sequence: Synthetic oligonucleotide
aagauuguaacuucaggc

SEQ ID NO: 2481 - RNA, 18 nt, Artificial Sequence
  Description of Artificial Sequence: Synthetic oligonucleotide
gcaagaagauuguaacuu

SEQ ID NO: 2482 - RNA, 18 nt, Artificial Sequence
  Description of Artificial Sequence: Synthetic oligonucleotide
aggaggcaagaagauugu

SEQ ID NO: 2483 - RNA, 18 nt, Artificial Sequence
  Description of Artificial Sequence: Synthetic oligonucleotide
ccaaaaggaggcaagaag

SEQ ID NO: 2484 - RNA, 18 nt, Artificial Sequence
  Description of Artificial Sequence: Synthetic oligonucleotide
aauggccaaaaggaggca

SEQ ID NO: 2485 - RNA, 18 nt, Artificial Sequence
  Description of Artificial Sequence: Synthetic oligonucleotide
uguuuaauggccaaaagg

SEQ ID NO: 2486 - RNA, 18 nt, Artificial Sequence
  Description of Artificial Sequence: Synthetic oligonucleotide
acauuuguuuaauggcca

SEQ ID NO: 2487 - RNA, 18 nt, Artificial Sequence
  Description of Artificial Sequence: Synthetic oligonucleotide
uauacacauuuguuuaau

SEQ ID NO: 2488 - RNA, 18 nt, Artificial Sequence
  Description of Artificial Sequence: Synthetic oligonucleotide
cccucuauacacauuugu

SEQ ID NO: 2489 - RNA, 18 nt, Artificial Sequence
  Description of Artificial Sequence: Synthetic oligonucleotide
gcaggcccucuauacaca

SEQ ID NO: 2490 - RNA, 18 nt, Artificial Sequence
  Description of Artificial Sequence: Synthetic oligonucleotide
acauagcaggcccucuau

SEQ ID NO: 2491 - RNA, 18 nt, Artificial Sequence
  Description of Artificial Sequence: Synthetic oligonucleotide
auggcacauagcaggccc

SEQ ID NO: 2492 - RNA, 18 nt, Artificial Sequence
  Description of Artificial Sequence: Synthetic oligonucleotide
agcacauggcacauagca

SEQ ID NO: 2493 - RNA, 18 nt, Artificial Sequence
  Description of Artificial Sequence: Synthetic oligonucleotide
ggcauagcacauggcaca

SEQ ID NO: 2494 - RNA, 18 nt, Artificial Sequence
  Description of Artificial Sequence: Synthetic oligonucleotide
ugccuggcauagcacaug

SEQ ID NO: 2495 - RNA, 18 nt, Artificial Sequence
  Description of Artificial Sequence: Synthetic oligonucleotide
cuuagugccuggcauagc

SEQ ID NO: 2496 - RNA, 18 nt, Artificial Sequence
  Description of Artificial Sequence: Synthetic oligonucleotide
guauccuuagugccuggc

SEQ ID NO: 2497 - RNA, 18 nt, Artificial Sequence
  Description of Artificial Sequence: Synthetic oligonucleotide
gugccguauccuuagugc

SEQ ID NO: 2498 - RNA, 18 nt, Artificial Sequence
  Description of Artificial Sequence: Synthetic oligonucleotide
guucagugccguauccuu

SEQ ID NO: 2499 - RNA, 18 nt, Artificial Sequence
  Description of Artificial Sequence: Synthetic oligonucleotide
agaggguucagugccgua

SEQ ID NO: 2500 - RNA, 18 nt, Artificial Sequence
  Description of Artificial Sequence: Synthetic oligonucleotide
ugcuaagaggguucagug

SEQ ID NO: 2501 - RNA, 18 nt, Artificial Sequence
  Description of Artificial Sequence: Synthetic oligonucleotide
gagagugcuaagaggguu

SEQ ID NO: 2502 - RNA, 18 nt, Artificial Sequence
  Description of Artificial Sequence: Synthetic oligonucleotide
ggaaugagagugcuaaga

SEQ ID NO: 2503 - RNA, 18 nt, Artificial Sequence
  Description of Artificial Sequence: Synthetic oligonucleotide
ccucuggaaugagagugc

SEQ ID NO: 2504 - RNA, 18 nt, Artificial Sequence
  Description of Artificial Sequence: Synthetic oligonucleotide
aauccccucuggaaugag

SEQ ID NO: 2505 - RNA, 18 nt, Artificial Sequence
  Description of Artificial Sequence: Synthetic oligonucleotide
ggauuaauccccucugga

SEQ ID NO: 2506 - RNA, 18 nt, Artificial Sequence
  Description of Artificial Sequence: Synthetic oligonucleotide
cuuauggauuaauccccu

SEQ ID NO: 2507 - RNA, 18 nt, Artificial Sequence
  Description of Artificial Sequence: Synthetic oligonucleotide
uucuacuuauggauuaau

SEQ ID NO: 2508 - RNA, 18 nt, Artificial Sequence
  Description of Artificial Sequence: Synthetic oligonucleotide
ccccauucuacuuaugga

SEQ ID NO: 2509 - RNA, 18 nt, Artificial Sequence
  Description of Artificial Sequence: Synthetic oligonucleotide
gucacccccauucuacuu

SEQ ID NO: 2510 - RNA, 18 nt, Artificial Sequence
  Description of Artificial Sequence: Synthetic oligonucleotide
uuccagucacccccauuc

SEQ ID NO: 2511 - RNA, 18 nt, Artificial Sequence
  Description of Artificial Sequence: Synthetic oligonucleotide
cccuauuccagucacccc

SEQ ID NO: 2512 - RNA, 18 nt, Artificial Sequence
  Description of Artificial Sequence: Synthetic oligonucleotide
gcuggcccuauuccaguc

SEQ ID NO: 2513 - RNA, 18 nt, Artificial Sequence
  Description of Artificial Sequence: Synthetic oligonucleotide
ccccagcuggcccuauuc

SEQ ID NO: 2514 - RNA, 18 nt, Artificial Sequence
  Description of Artificial Sequence: Synthetic oligonucleotide
ggauuaauccccucugga

SEQ ID NO: 2515 - RNA, 18 nt, Artificial Sequence
  Description of Artificial Sequence: Synthetic oligonucleotide
cuuauggauuaauccccu

SEQ ID NO: 2516 - RNA, 18 nt, Artificial Sequence
  Description of Artificial Sequence: Synthetic oligonucleotide
uucuacuuauggauuaau

SEQ ID NO: 2517 - RNA, 18 nt, Artificial Sequence
  Description of Artificial Sequence: Synthetic oligonucleotide
ccccauucuacuuaugga

SEQ ID NO: 2518 - RNA, 18 nt, Artificial Sequence
  Description of Artificial Sequence: Synthetic oligonucleotide
gucacccccauucuacuu

SEQ ID NO: 2519 - RNA, 18 nt, Artificial Sequence
  Description of Artificial Sequence: Synthetic oligonucleotide
uuccagucacccccauuc

SEQ ID NO: 2520 - RNA, 18 nt, Artificial Sequence
  Description of Artificial Sequence: Synthetic oligonucleotide
cccuauuccagucacccc

SEQ ID NO: 2521 - RNA, 18 nt, Artificial Sequence
  Description of Artificial Sequence: Synthetic oligonucleotide
gcuggcccuauuccaguc

SEQ ID NO: 2522 - RNA, 18 nt, Artificial Sequence
  Description of Artificial Sequence: Synthetic oligonucleotide
ccccagcuggcccuauuc

SEQ ID NO: 2523 - RNA, 18 nt, Artificial Sequence
  Description of Artificial Sequence: Synthetic oligonucleotide
caagcccccagcuggccc

SEQ ID NO: 2524 - RNA, 18 nt, Artificial Sequence
  Description of Artificial Sequence: Synthetic oligonucleotide
gccuccaagcccccagcu

SEQ ID NO: 2525 - RNA, 18 nt, Artificial Sequence
  Description of Artificial Sequence: Synthetic oligonucleotide
uucaugccuccaagcccc

SEQ ID NO: 2526 - RNA, 18 nt, Artificial Sequence
  Description of Artificial Sequence: Synthetic oligonucleotide
ugaucuucaugccuccaa

SEQ ID NO: 2527 - RNA, 18 nt, Artificial Sequence
  Description of Artificial Sequence: Synthetic oligonucleotide
ggaucugaucuucaugcc

SEQ ID NO: 2528 - RNA, 18 nt, Artificial Sequence
  Description of Artificial Sequence: Synthetic oligonucleotide
auucaggaucugaucuuc

SEQ ID NO: 2529 - RNA, 18 nt, Artificial Sequence
  Description of Artificial Sequence: Synthetic oligonucleotide
uucugauucaggaucuga

SEQ ID NO: 2530 - RNA, 18 nt, Artificial Sequence
  Description of Artificial Sequence: Synthetic oligonucleotide
uguuguucugauucagga

SEQ ID NO: 2531 - RNA, 18 nt, Artificial Sequence
  Description of Artificial Sequence: Synthetic oligonucleotide
ucuccuguuguucugauu

SEQ ID NO: 2532 - RNA, 18 nt, Artificial Sequence
  Description of Artificial Sequence: Synthetic oligonucleotide
gaauuucuccuguuguuc

SEQ ID NO: 2533 - RNA, 18 nt, Artificial Sequence
  Description of Artificial Sequence: Synthetic oligonucleotide
ccagagaauuucuccugu

SEQ ID NO: 2534 - RNA, 18 nt, Artificial Sequence
  Description of Artificial Sequence: Synthetic oligonucleotide
gaaugccagagaauuucu

SEQ ID NO: 2535 - RNA, 18 nt, Artificial Sequence
  Description of Artificial Sequence: Synthetic oligonucleotide
gaguugaaugccagagaa

SEQ ID NO: 2536 - RNA, 18 nt, Artificial Sequence
  Description of Artificial Sequence: Synthetic oligonucleotide
gaugugaguugaaugcca

SEQ ID NO: 2537 - RNA, 18 nt, Artificial Sequence
  Description of Artificial Sequence: Synthetic oligonucleotide
ccagagaugugaguugaa

SEQ ID NO: 2538 - RNA, 18 nt, Artificial Sequence
  Description of Artificial Sequence: Synthetic oligonucleotide
gaaugccagagaugugag

SEQ ID NO: 2539 - RNA, 18 nt, Artificial Sequence
  Description of Artificial Sequence: Synthetic oligonucleotide
ccucugaaugccagagau

SEQ ID NO: 2540 - RNA, 18 nt, Artificial Sequence
  Description of Artificial Sequence: Synthetic oligonucleotide
uaucaccucugaaugcca

SEQ ID NO: 2541 - RNA, 18 nt, Artificial Sequence
  Description of Artificial Sequence: Synthetic oligonucleotide
gccuuuaucaccucugaa

SEQ ID NO: 2542 - RNA, 18 nt, Artificial Sequence
  Description of Artificial Sequence: Synthetic oligonucleotide
cuguagccuuuaucaccu

SEQ ID NO: 2543 - RNA, 18 nt, Artificial Sequence
  Description of Artificial Sequence: Synthetic oligonucleotide
cccugcuguagccuuuau

SEQ ID NO: 2544 - RNA, 18 nt, Artificial Sequence
  Description of Artificial Sequence: Synthetic oligonucleotide
uauugcccugcuguagcc

SEQ ID NO: 2545 - RNA, 18 nt, Artificial Sequence
  Description of Artificial Sequence: Synthetic oligonucleotide
aguccuauugcccugcug

SEQ ID NO: 2546 - RNA, 18 nt, Artificial Sequence
  Description of Artificial Sequence: Synthetic oligonucleotide
gucccaguccuauugccc

SEQ ID NO: 2547 - RNA, 18 nt, Artificial Sequence
  Description of Artificial Sequence: Synthetic oligonucleotide
cgacagucccaguccuau

SEQ ID NO: 2548 - RNA, 18 nt, Artificial Sequence
  Description of Artificial Sequence: Synthetic oligonucleotide
ggagacgacagucccagu

SEQ ID NO: 2549 - RNA, 18 nt, Artificial Sequence
  Description of Artificial Sequence: Synthetic oligonucleotide
ccaaaggagacgacaguc

SEQ ID NO: 2550 - RNA, 18 nt, Artificial Sequence
  Description of Artificial Sequence: Synthetic oligonucleotide
cacagccaaaggagacga

SEQ ID NO: 2551 - RNA, 18 nt, Artificial Sequence
  Description of Artificial Sequence: Synthetic oligonucleotide
aacagcacagccaaagga

SEQ ID NO: 2552 - RNA, 18 nt, Artificial Sequence
  Description of Artificial Sequence: Synthetic oligonucleotide
agggcaacagcacagcca

SEQ ID NO: 2553 - RNA, 18 nt, Artificial Sequence
  Description of Artificial Sequence: Synthetic oligonucleotide
uuuagagggcaacagcac

SEQ ID NO: 2554 - RNA, 18 nt, Artificial Sequence
  Description of Artificial Sequence: Synthetic oligonucleotide
guacauuuagagggcaac

SEQ ID NO: 2555 - RNA, 18 nt, Artificial Sequence
  Description of Artificial Sequence: Synthetic oligonucleotide
gcaggguacauuuagagg

SEQ ID NO: 2556 - RNA, 18 nt, Artificial Sequence
  Description of Artificial Sequence: Synthetic oligonucleotide
aaaaagcaggguacauuu

SEQ ID NO: 2557 - RNA, 18 nt, Artificial Sequence
  Description of Artificial Sequence: Synthetic oligonucleotide
gugggaaaaagcagggua

SEQ ID NO: 2558 - RNA, 18 nt, Artificial Sequence
  Description of Artificial Sequence: Synthetic oligonucleotide
aaaaggugggaaaaagca

SEQ ID NO: 2559 - RNA, 18 nt, Artificial Sequence
  Description of Artificial Sequence: Synthetic oligonucleotide
gaaagaaaaggugggaaa

SEQ ID NO: 2560 - RNA, 18 nt, Artificial Sequence
  Description of Artificial Sequence: Synthetic oligonucleotide
acagagaaagaaaaggug

SEQ ID NO: 2561 - RNA, 18 nt, Artificial Sequence
  Description of Artificial Sequence: Synthetic oligonucleotide
ggcgaacagagaaagaaa

SEQ ID NO: 2562 - RNA, 18 nt, Artificial Sequence
  Description of Artificial Sequence: Synthetic oligonucleotide
gugagggcgaacagagaa

SEQ ID NO: 2563 - RNA, 18 nt, Artificial Sequence
  Description of Artificial Sequence: Synthetic oligonucleotide
uggauggugucugagaau

SEQ ID NO: 2564 - RNA, 18 nt, Artificial Sequence
  Description of Artificial Sequence: Synthetic oligonucleotide
caauguggauggugucug

SEQ ID NO: 2565 - RNA, 18 nt, Artificial Sequence
  Description of Artificial Sequence: Synthetic oligonucleotide
ggguucaauguggauggu

SEQ ID NO: 2566 - RNA, 18 nt, Artificial Sequence
  Description of Artificial Sequence: Synthetic oligonucleotide
gcucagaggcuggcauug

SEQ ID NO: 2567 - RNA, 18 nt, Artificial Sequence
  Description of Artificial Sequence: Synthetic oligonucleotide
uguccgcucagaggcugg

SEQ ID NO: 2568 - RNA, 18 nt, Artificial Sequence
  Description of Artificial Sequence: Synthetic oligonucleotide
gccacuguccgcucagag

SEQ ID NO: 2569 - RNA, 18 nt, Artificial Sequence
  Description of Artificial Sequence: Synthetic oligonucleotide
cccaggccacuguccgcu

SEQ ID NO: 2570 - RNA, 18 nt, Artificial Sequence
  Description of Artificial Sequence: Synthetic oligonucleotide
ggagacccaggccacugu

SEQ ID NO: 2571 - RNA, 18 nt, Artificial Sequence
  Description of Artificial Sequence: Synthetic oligonucleotide
auguuggagacccaggcc

SEQ ID NO: 2572 - RNA, 18 nt, Artificial Sequence
  Description of Artificial Sequence: Synthetic oligonucleotide
gaggcauguuggagaccc

SEQ ID NO: 2573 - RNA, 18 nt, Artificial Sequence
  Description of Artificial Sequence: Synthetic oligonucleotide
caggugaggcauguugga

SEQ ID NO: 2574 - RNA, 18 nt, Artificial Sequence
  Description of Artificial Sequence: Synthetic oligonucleotide
gccgacaggugaggcaug

SEQ ID NO: 2575 - RNA, 18 nt, Artificial Sequence
  Description of Artificial Sequence: Synthetic oligonucleotide
ugucagccgacaggugag

SEQ ID NO: 2576 - RNA, 18 nt, Artificial Sequence
  Description of Artificial Sequence: Synthetic oligonucleotide
cucgaugucagccgacag

SEQ ID NO: 2577 - RNA, 18 nt, Artificial Sequence
  Description of Artificial Sequence: Synthetic oligonucleotide
gcacucucgaugucagcc

SEQ ID NO: 2578 - RNA, 18 nt, Artificial Sequence
  Description of Artificial Sequence: Synthetic oligonucleotide
ugugggcacucucgaugu

SEQ ID NO: 2579 - RNA, 18 nt, Artificial Sequence
  Description of Artificial Sequence: Synthetic oligonucleotide
cucgaugugggcacucuc

SEQ ID NO: 2580 - RNA, 18 nt, Artificial Sequence
  Description of Artificial Sequence: Synthetic oligonucleotide
ucccgcucgaugugggca

SEQ ID NO: 2581 - RNA, 18 nt, Artificial Sequence
  Description of Artificial Sequence: Synthetic oligonucleotide
acucuucccgcucgaugu

SEQ ID NO: 2582 - RNA, 18 nt, Artificial Sequence
  Description of Artificial Sequence: Synthetic oligonucleotide
cuuguacucuucccgcuc

SEQ ID NO: 2583 - RNA, 18 nt, Artificial Sequence
  Description of Artificial Sequence: Synthetic oligonucleotide
uugagcuuguacucuucc

SEQ ID NO: 2584 - RNA, 18 nt, Artificial Sequence
  Description of Artificial Sequence: Synthetic oligonucleotide
acuccuugagcuuguacu

SEQ ID NO: 2585 - RNA, 18 nt, Artificial Sequence
  Description of Artificial Sequence: Synthetic oligonucleotide
ugaguacuccuugagcuu

SEQ ID NO: 2586 - RNA, 18 nt, Artificial Sequence
  Description of Artificial Sequence: Synthetic oligonucleotide
gauuuugaguacuccuug

SEQ ID NO: 2587 - RNA, 18 nt, Artificial Sequence
  Description of Artificial Sequence: Synthetic oligonucleotide
ccaucgauuuugaguacu

SEQ ID NO: 2588 - RNA, 18 nt, Artificial Sequence
  Description of Artificial Sequence: Synthetic oligonucleotide
cucauccaucgauuuuga

SEQ ID NO: 2589 - RNA, 18 nt, Artificial Sequence
  Description of Artificial Sequence: Synthetic oligonucleotide
cggcucucauccaucgau

SEQ ID NO: 2590 - RNA, 18 nt, Artificial Sequence
  Description of Artificial Sequence: Synthetic oligonucleotide
ccagccggcucucaucca

SEQ ID NO: 2591 - RNA, 18 nt, Artificial Sequence
  Description of Artificial Sequence: Synthetic oligonucleotide
ccuauccagccggcucuc

SEQ ID NO: 2592 - DNA, 1729 bp, Homo sapiens
ctctatggacatggctcgcctcccctccccaaccaaggaaaagccacccccaccaccgcctggtggtggtaaagacctgttctatgtaagccgtccacccctggcccgttcctcaccagcatactgcacgagcagctcggacatcacagagccagagcagaagatgctgagtgtcaacaagagtgtgtccatgctggacttacagggtgatgggcctggtggccgcctcaacagcagcagtgtttcgaacctggcggccgtaggggacctgctgcactcaagccaggcctcgctgacagcagccttggggctacggcctgcgcctgccggacgcctctcccaggggagtggctcatccatcacggcggctggcatgcgcctcagccagatgggtgtcaccacagacggtgtccctgcccagcaactgcgaatccccctctccttccagaaccctctcttccacatggctgctgatgggccaggtcccccaggcggccatggagggggcggtggccatggcccaccttcctcccatcaccaccaccaccaccatcaccaccaccgaggtggagagccccctggggacacctttgccccattccatggctatagcaagagtgaggacctctcttccggggtccccaagccccctgctgcctccatccttcatagccacagctacagtgatgagtttggaccctctggcactgacttcacccgtcggcagctttcactccaggacaacctgcagcacatgctgtcccctccccagatcaccattggtccccagaggccagccccctcagggcctggaggtgggagcggtgggggcagcggtgggggtggcgggggccagccgcctccattgcagaggggcaagtctcagcagttgacagtcagcgcagcccagaaaccccggccatccagcgggaatctattgcagtccccagagccaagttatggccccgcccgtccacggcaacagagcctcagcaaggagggcagcattgggggcagcgggggcagcggtggcggagggggtggggggctgaagccctccatcaccaagcaggtaggtgaaggcaggaggaaggcgggctgggtcacaacagggagggaagaaggagatggggggtggggttgaaacagagtctgtggcctgaagttacaatcttcttgcctccttttggccattaaacaaatgtgtatagagggcctgctatgtgccatgtgctatgccaggcactaaggatacggcactgaaccctcttagcactctcattccagaggggattaatccataagtagaatgggggtgactggaatagggccagctgggggcttggaggcatgaagatcagatcctgaatcagaacaacaggagaaattctctggcattcaactcacatctctggcattcagaggtgataaaggctacagcagggcaataggactgggactgtcgtctcctttggctgtgctgttgccctctaaatgtaccctgctttttcccaccttttctttctctgttcgccctcactgtgccttgtcccagcattctcagacaccatccacattgaaccccacaatgccagcctctgagcggacagtggcctgggtctccaacatgcctcacctgtcggctgacatcgagagtgcccacatcgagcgggaagagtacaagctcaaggagtactcaaaatcgatggatgagagccggctggatagg

SEQ ID NO: 2593 - DNA, 3031 bp, Homo sapiens
gtggttgtgaatgcccttttaggagcaattccatccatcatgaatgtgcttctggtttgtcttatattctggctaattttcagcatcatgggcgtaaatttgtttgctggcaaattctaccactgtattaacaccacaactggtgacaggtttgacatcgaagacgtgaataatcatactgattgcctaaaactaatagaaagaaatgagactgctcgatggaaaaatgtgaaagtaaactttgataatgtaggatttgggtatctctctttgcttcaagttgtaagtgaacactattttctctgaatatttttattgtttggaataataacaaaataatgacatacatctattatttagttcctaagaaaaagtatatatttctttctatttaaaaaatttcaatttgttagtacaagtttatgagcccagatgggtgaaaactttattacatgtaaggactgcagatatagtcagtagtgaccagaccaaacaaagacctctttgtcttttttcttgtattttctttgtttctatattgctctttctatataaacaagtaaattaataaatcagtaactttgccattttttattgtgattagaaggcttgtttccctgatcagctaccaaaacggaatacacttaacagatagatcatcttccaaaacacatacacttaatacacctaattggattgtaattaattggtagggattaactgctgctgagttctattatttggatcaaagtttggggaatgacatttaggttttagaattagaaccaggcatagcggtgggtgccactgcactccagcctgggcaacaaagagtgaaactccatctaaaaaaaaaaaaaaaaaaaaaaaaaaagagagagaattatacctggaagcaactagaaacaaaaatgaagcaaaagcagctgttgtcttatctcaaatgacctttcagcaccattatttaagtctattttgtcctaaatattaatgttttcactactgggtctctaagactgggtctccaagaaaaatagtttataatttatatttaaaaaaggtagccctttaaacattttcatttgattctgcttctagctgcagcagcaccacaacaaagcagggaataaaataagagtccagattatttgaaaactcagcttaaaaaaaaaagactgtacaatttctttcttcccttgtggttctacagtgtctttagggcagaaatcaatttttgctcaccaaggttatgatttcaactgttcaaccagaagactaactaagcaaacaaaccaacactggtcaaaacccttttgcagctcttccagaggtgtcaactatgattactttacaaattcttcccacctttttgttggaaattcttatttctcttcttaacatttttgatctactctgaataatattcatgcaattaaaatagagattttttaaatctggtaagaacgggtggggcatggtggctcatgcctgtaatcctagctctttgggaggccaaagctggaggattgcttgaggccaggagatctagaccagtggaggcaacatagtgagaccttgtctctaaagacaaataaaaacaaaagttaaaaaaaatctagcaagaatgctttctttaaaaattgtcgacacatgatgatatttatttgggcacttattctaacccttaactaatgaccatacttgtaaatatcactaaagcaaccacctcctccataaatttgaggaaagaaaaattaaaaattttaagcaatcctttaaaatgtaagcaattctgaaaatacagtgatggtcctgcacaaagctattaaataaattctgccaccaaaaaaaaaaaaaaccctctaaaatactgcttcacatttggcttttatagaatcacctctctattgattagtaagtcattgaaatggtcccttgaatcacttttttgtttctataccaagtgtgtaatggaattgttctatcattgacctaagccactgacatatttaacacatctctctctctttcatatacaaaagccttgtactttctagctaggaatcattactttcttttcactgctgtcacccacacccttgcttagcttttgtctcatgaaatccaccacctcacaagggttagcgttatcagaacaaagatatattgtgatacagacgctaaaggctttgctaacctccctcactagctaagggataatccttttaggcccacaggactcaaaattcatgccccaggacaagtaacaaattactgtaagttgttagcctgagtatccttcatcctgtgagtgccaagtgtctgctgtactattgttcacatttcttattcatattaacttattatcttcaagaatttcagaaagaaaatagaatagggggttatttctaaatgttttgatgcaaaattcttaaaaggattgtatttctaaatgttttgctccaaaattcttaaaaggatagttgcaaccctgcctttatgtatcctggtactatccttacattgttacaataaagagaaatcttaaattttcaatcactttgatcaccctgcagataaattttagcagatgatccttagatctaagttgtaattatttggctgatagagctattgacccatgtgttggcatttgtaagactttctaaaaagtgctccagcaaattttaatactgctttaaatatcatgacaccatgaactctaaagaattgaaaagtgcttgtgagttggttatcaaggggaggatatatcaaatggccattttgttcaatatgtgttctagaaatgaaaagccatactaaaatactgtcttggtccaaaatctgtgtaaaatttgttttgaaatgtctttcaaaaatattcccttttgaaaattatatcagtaagaatatttattaaacatcaggtctaaattatttttactccaaagtaaaacatgcatgtccttcttaataggccacattcaaaggatggatggatataatgtatgcagcagttgattccagaaat

SEQ ID NO: 2594 - DNA, 5847 bp, Homo sapiens
gctgatgctggtggaggaggagctgcgccgggaccaccccgccatggctgagccgctgccagaacccaagaagaggctgctcgacgctcaggtggaaattacaatgtcatttatcttctccgtgtcccatccccatccatcccactgtctttcgtgcactcactacaccagccacctagccccatcaccatctgtctctcatagtctgctgtttgtccactggctgctcctggcagccccctagtgaccccatcttcatcccatcgtctgtgcctttgtcactcctggcagcgtcagcccaactcctgtgccttcccatccagtcttcccactcctctctgcatctcaggaccttctctaccagaaccttggtctttctgcccctagaccccacctagttccaagaacccctgccccttctttgctcactcctattcaagccacgttgttcagcttcctctgcgctcttgggccagagggctagaagctgccgttttctggaatagagcacagggcagtatgatctgtagtttctccaggccctggccggtaccctgaaaacttggggacccatcacctctgttctcttggctccctaattttcctgtctccttggcagctcctgcatagcttcctcttcctgactcttcagatcttgaaggccttccatcctgtaacctccctttgccctcagtatttaagtccagcctccctctggcctccctcccactctggccctcagaccttcccagctgcctgctgcccagcctctcttctcacaagccagcttctaggacctcccttctgcacccttaccccttgctttcccaaaattctgctcattttcctacccatactcctctttgctctgactgctaggctccccccgcctgccatccccccaccaaggctcctgaccccatgaccccactctctcccactgcagctcctcatcaggtaattctcctggttccgctttggccacgggcggaggacacagggggaggtgactccggaccactgcaggttggtcgtgaagcccactccctccaacacctccggagcctctcccctctcactgctgccctccacacccagagaacctccacagactccagccctccgacacctgcacagatccatctcccaagacaccacccaaagagagcatttgctgctgcttcccagaactgtccaacaataccttagcaacaccaagagttgggccctagatgggcccagcacattcacaggtcacacccacttccctgcaaaacccaccccctcccagcctcctcctgactctaagccctcctcttcctctacctctccagtgtatgtctgtcaccccccatttcaccagagcgtccttaggggctgggggtgggtttgttaatggggtggaggcaatgatgggttggaggatcttggctataggggctgtgctgactgcagcaggtaggttgggtttccctcttccttccctaatcttggttctctaccctcctttccactcctcacctgattctctctcttcctcctccttatatctgtgaggcagaaggcatctgaagctcatattagcccccattgggtgggaattaggagtgggtagttaactcagggagacttgagataccctggaaaaaatgctattgagatgtcctgacattaggcagggtggatggaacaagaaggagcaagaaaggaacctcaggcagatgttaggacatggacttgatcatgtggcctgggagtttagaaatggggagagacatcctcctagatcagatcgtgggctcagtaggcatgttgattcccagggagaggtgccaggaacagcatggtaaagaatgtactcttcacagctcacatccccaggttgctgatgccactcactccccctctcctgccatcgagtggccttgccggacacatcaccctacctaaaaagccagtaaatgagaacctgtcagctatagccatcatttctgagatgcgattttctttgggattgagctgcagtgggcagtggctccttacactgtaattttaattctctgcctgcccagcctctctgtcaaagtagctggtgatctataaagatgctaaaaggcaccaggggactttgccatttaaaggactcctgcagtgaattcttttgtaaaatgaataatggcaccctaatttatccactttctaaatttgggtccatgggggtgtccagggcatgcttatgtgctgtcaccagcagacaaacagagggaatggaatctgggggttccttccctgctctcccgccatactcaggataccctaccataagtgatttcctctcactgacttgcagaaaatgtgtgagatacccagcaagctaagaaggcagttttgctgggtatctcatacccaaggctggggtttgggtgatctgagaggttagctccttgatcctaggatggaagggagagcttatatagaagcttttacttggaaggttttgtatcctaaggtcagacatagctatattaccaagcctaaatgccatgtggcccaggaaataatttggacatttgttctaaaccacttgtggtaggtattggtctctctgcaactcagccattaattagaaattagttttgagcctgaattttaaaaagccaagtgttgcccccagcccacacacacacacacggacatgtacagtacaaaccccagataattacaacagccaaagagagaaggaagtgaatttcccaaccagaagcgtagggaaattcagatggctttcttttctcccagcagaggaacagaaggcggagctaagggcaggaaccaggagttggtcaaggagctataggaggtgatgagagtagaaccaggggtaggagctggtctggtacccctcaccctctaattgggagcccagggagaaggactgaaaagaagatgggagtggaaaagaataaagccagtttctgcttcccagggatgcagagattggggcatgctgtgtctgcagaagctcctagtcatttccgccataattgtgagagagaggggcagccctcccacaagatttttcccttcccatatcacttccctgaatccccttcctttccccccagtacagttaaacctctctctaatttggaatgttatatttgagaagatggccactgtgaataagtgacaaacggaatgacagtgtctatttaatgaaatgcatgtcttcaaaatatatacagaactcgatgaacaaggctttttccactcctcagggagcatgcattaatgaatagataggattcaaaagtctgttttctggtatgggttaaatatcccctcctacagacatatttccaccactaatttgcttagtacaccttttcttcacagataaaggaaaatgcaagctcagtttttcttcagattatgaagaaattccaaatccacaggggtttggattaatgaggttttgctgtactgcctccccttattcctcaacatgaagttcccacctcggattggggatgggtgggagggggtttcaagaggaggagggtgggatgggcaaggaatatacacaggtgaagccagagaagggttaggttgggggtgcggtgggaacttgctgttttgatctggtttcctggtgtgacactctgggttaaaggcttgaaggcccctgttaggagtctaggggtgagattctcttctctctgatcccagaggacgttaacttctactgcaggtgagaaacaaaataggaggatggtggggactgtcctgggaggagggggtggtccatggcttgtggtgtgggctggctataggggaggccactgctaggggactggcatccaggcccccttgaagcgtctcaataagtccgcgctctcctttttggtgtcttgcaggagaggcagcttccccccttgggtccaacaaacccgcgtgtgacgctggccccaccgtggaatggcctggcccccccagccccaccacccccaccccggctgcagattacggagaacggcgagttccgaaacaccgcagaccactagcccacccagcatcagagaccttctcttcctttcctgtgcaccccaccctgtaacagcaccaaccaccaggattggacatcaccgaggaacagcgggattgcctccccgaatgcctccctgggaggcacactgattgcccacccccaccactgcaccatttccaggagggagagtggggaccctcagccgcccccttttccttcccattggggtgctgccctctctttgacccccagggacccttgccccaggacaccgcctaccccgtacagaccccttcactccggggtgctatccccatcctctgcctcatcgttcccctgagcactgggggacagaccctcacccccaccctgggggtgtggcacctccaaactttcaacttcagggtgatttttttagcagtaaccagagctgacaatctaactcccctccaccgccccattttggcctcccctgccccccttgttatggggaggggaccccgggtgagggggccctattaccccttgatttctcaggagcgtctgggggggctcagcacgcacaaactccttctccttctaccactcttaaatttactccctccccacccagaacccagatggggtggagggggccaccggggcagggagggggcggcaaggggggaatgggagttgtctccccttctccccacacctgatctgctctcggctggtcccagagcggggtgagggggcttatgcccccccctcccccagtgtgttgggtggggtggaattgaggttagggtgaggggtcagggtttaggagggtgtgtatgttgggaggacaggctagttgatctgtcctactctgacacacagtcccctctgccccttccttctctcttcttggtctctactcccagggggaggggggaacttactctaggaaaagccatgtctctctcccccagggtggggggacctgtgttggaggaggggtgttggggggcccccttccatgactctgtcccctgggggaggtaggacagggctgggcttccctctcatcctccccctcccaatctccttccacctccctccctcccgccagctccacgatttttcggtgtttctctgtacatagttttctggcgggataggggaggtaggatggatggggtttggggtgggtaggccatgggaggggagaagcccctccttggcaccccctcttccctgactgctgtcccctacccagccttgcccccttcatccttttgcgtttggtattgagactctcctagactctactcctctttcttttgtatggacagttccccttcagtcccatccccctacacatacacccagccggggccaaatttatacttatataaaagttgtaaatatgtgaaattttatccctgtgccctttccccacctcaggccctacccctggaccctccccaaccttccttctctcttctttggctgttgtaattatctggggtttgtactgtacatatccggggtgtgtgtgtgtgggctgggggcaacccttctgtacagagcttcctggccccctccccccccgcccctctgcttccctccccacccaccacctcaagggtagggagttgctcttcctacctgttttattttgttttctcgttctccctccccaccccactcccagccttatctatcccccctcactgtccccttttctccactcccagccccatttcctttttttctggagtgtgtggtgaaacagaaaaaaacatgtttaataaacggagattgttctttta

SEQ ID NO: 2595 - DNA, 5847 bp, Homo sapiens
gctgatgctggtggaggaggagctgcgccgggaccaccccgccatggctgagccgctgccagaacccaagaagaggctgctcgacgctcaggtggaaattacaatgtcatttatcttctccgtgtcccatccccatccatcccactgtctttcgtgcactcactacaccagccacctagccccatcaccatctgtctctcatagtctgctgtttgtccactggctgctcctggcagccccctagtgaccccatcttcatcccatcgtctgtgcctttgtcactcctggcagcgtcagcccaactcctgtgccttcccatccagtcttcccactcctctctgcatctcaggaccttctctaccagaaccttggtctttctgcccctagaccccacctagttccaagaacccctgccccttctttgctcactcctattcaagccacgttgttcagcttcctctgcgctcttgggccagagggctagaagctgctgttttctggaatagagcacagggcagtatgatctgtagtttctccaggccctggccggtaccctgaaaacttggggacccatcacctctgttctcttggctccctaattttcctgtctccttggcagctcctgcatagcttcctcttcctgactcttcagatcttgaaggccttccatcctgtaacctccctttgccctcagtatttaagtccagcctccctctggcctccctcccactctggccctcagaccttcccagctgcctgctgcccagcctctcttctcacaagccagcttctaggacctcccttctgcacccttaccccttgctttcccaaaattctgctcattttcctacccatactcctctttgctctgactgctaggctccccccgcctgccatccccccaccaaggctcctgaccccatgaccccactctctcccactgcagctcctcatcaggtaattctcctggttccgctttggccacgggcggaggacacagggggaggtgactccggaccactgcaggttggtcgtgaagcccactccctccaacacctccggagcctctcccctctcactgctgccctccacacccagagaacctccacagactccagccctccgacacctgcacagatccatctcccaagacaccacccaaagagagcatttgctgctgcttcccagaactgtccaacaataccttagcaacaccaagagttgggccctagatgggcccagcacattcacaggtcacacccacttccctgcaaaacccaccccctcccagcctcctcctgactctaagccctcctcttcctctacctctccagtgtatgtctgtcaccccccatttcaccagagcgtccttaggggctgggggtgggtttgttaatggggtggaggcaatgatgggttggaggatcttggctataggggctgtgctgactgcagcaggtaggttgggtttccctcttccttccctaatcttggttctctaccctcctttccactcctcacctgattctctctcttcctcctccttatatctgtgaggcagaaggcatctgaagctcatattagcccccattgggtgggaattaggagtgggtagttaactcagggagacttgagataccctggaaaaaatgctattgagatgtcctgacattaggcagggtggatggaacaagaaggagcaagaaaggaacctcaggcagatgttaggacatggacttgatcatgtggcctgggagtttagaaatggggagagacatcctcctagatcagatcgtgggctcagtaggcatgttgattcccagggagaggtgccaggaacagcatggtaaagaatgtactcttcacagctcacatccccaggttgctgatgccactcactccccctctcctgccatcgagtggccttgccggacacatcaccctacctaaaaagccagtaaatgagaacctgtcagctatagccatcatttctgagatgcgattttctttgggattgagctgcagtgggcagtggctccttacactgtaattttaattctctgcctgcccagcctctctgtcaaagtagctggtgatctataaagatgctaaaaggcaccaggggactttgccatttaaaggactcctgcagtgaattcttttgtaaaatgaataatggcaccctaatttatccactttctaaatttgggtccatgggggtgtccagggcatgcttatgtgctgtcaccagcagacaaacagagggaatggaatctgggggttccttccctgctctcccgccatactcaggataccctaccataagtgatttcctctcactgacttgcagaaaatgtgtgagatacccagcaagctaagaaggcagttttgctgggtatctcatacccaaggctggggtttgggtgatctgagaggttagctccttgatcctaggatggaagggagagcttatatagaagcttttacttggaaggttttgtatcctaaggtcagacatagctatattaccaagcctaaatgccatgtggcccaggaaataatttggacatttgttctaaaccacttgtggtaggtattggtctctctgcaactcagccattaattagaaattagttttgagcctgaattttaaaaagccaagtgttgcccccagcccacacacacacacacggacatgtacagtacaaaccccagataattacaacagccaaagagagaaggaagtgaatttcccaaccagaagcgtagggaaattcagatggctttcttttctcccagcagaggaacagaaggcggagctaagggcaggaaccaggagttggtcaaggagctataggaggtgatgagagtagaaccaggggtaggagctggtctggtacccctcaccctctaattgggagcccagggagaaggactgaaaagaagatgggagtggaaaagaataaagccagtttctgcttcccagggatgcagagattggggcatgctgtgtctgcagaagctcctagtcatttccgccataattgtgagagagaggggcagccctcccacaagatttttcccttcccatatcacttccctgaatccccttcctttccccccagtacagttaaacctctctctaatttggaatgttatatttgagaagatggccactgtgaataagtgacaaacggaatgacagtgtctatttaatgaaatgcatgtcttcaaaatatatacagaactcgatgaacaaggctttttccactcctcagggagcatgcattaatgaatagataggattcaaaagtctgttttctggtatgggttaaatatcccctcctacagacatatttccaccactaatttgcttagtacaccttttcttcacagataaaggaaaatgcaagctcagtttttcttcagattatgaagaaattccaaatccacaggggtttggattaatgaggttttgctgtactgcctccccttattcctcaacatgaagttcccacctcggattggggatgggtgggagggggtttcaagaggaggagggtgggatgggcaaggaatatacacaggtgaagccagagaagggttaggttgggggtgcggtgggaacttgctgttttgatctggtttcctggtgtgacactctgggttaaaggcttgaaggcccctgttaggagtctaggggtgagattctcttctctctgatcccagaggacgttaacttctactgcaggtgagaaacaaaataggaggatggtggggactgtcctgggaggagggggtggtccatggcttgtggtgtgggctggctataggggaggccactgctaggggactggcatccaggcccccttgaagcgtctcaataagtccgcgctctcctttttggtgtcttgcaggagaggcagcttccccccttgggtccaacaaacccgcgtgtgacgctggccccaccgtggaatggcctggcccccccagccccaccacccccaccccggctgcagattacggagaacggcgagttccgaaacaccgcagaccactagcccacccagcatcagagaccttctcttcctttcctgtgcaccccaccctgtaacagcaccaaccaccaggattggacatcaccgaggaacagcgggattgcctccccgaatgcctccctgggaggcacactgattgcccacccccaccactgcaccatttccaggagggagagtggggaccctcagccgcccccttttccttcccattggggtgctgccctctctttgacccccagggacccttgccccaggacaccgcctaccccgtacagaccccttcactccggggtgctatccccatcctctgcctcatcgttcccctgagcactgggggacagaccctcacccccaccctgggggtgtggcacctccaaactttcaacttcagggtgatttttttagcagtaaccagagctgacaatctaactcccctccaccgccccattttggcctcccctgccccccttgttatggggaggggaccccgggtgagggggccctattaccccttgatttctcaggagcgtctgggggggctcagcacgcacaaactccttctccttctaccactcttaaatttactccctccccacccagaacccagatggggtggagggggccaccggggcagggagggggcggcaaggggggaatgggagttgtctccccttctccccacacctgatctgctctcggctggtcccagagcggggtgagggggcttatgcccccccctcccccagtgtgttgggtggggtggaattgaggttagggtgaggggtcagggtttaggagggtgtgtatgttgggaggacaggctagttgatctgtcctactctgacacacagtcccctctgccccttccttctctcttcttggtctctactcccagggggaggggggaacttactctaggaaaagccatgtctctctcccccagggtggggggacctgtgttggaggaggggtgttggggggcccccttccatgactctgtcccctgggggaggtaggacagggctgggcttccctctcatcctccccctcccaatctccttccacctccctccctcccgccagctccacgatttttcggtgtttctctgtacatagttttctggcgggataggggaggtaggatggatggggtttggggtgggtaggccatgggaggggagaagcccctccttggcaccccctcttccctgactgctgtcccctacccagccttgcccccttcatccttttgcgtttggtattgagactctcctagactctactcctctttcttttgtatggacagttccccttcagtcccatccccctacacatacacccagccggggccaaatttatacttatataaaagttgtaaatatgtgaaattttatccctgtgccctttccccacctcaggccctacccctggaccctccccaaccttccttctctcttctttggctgttgtaattatctggggtttgtactgtacatatccggggtgtgtgtgtgtgggctgggggcaacccttctgtacagagcttcctggccccctccccccccgcccctctgcttccctccccacccaccacctcaagggtagggagttgctcttcctacctgttttattttgttttctcgttctccctccccaccccactcccagccttatctatcccccctcactgtccccttttctccactcccagccccatttcctttttttctggagtgtgtggtgaaacagaaaaaaacatgtttaataaacggagattgttctttta

SEQ ID NO: 2596 - RNA, 18 nt, Artificial Sequence
  Description of Artificial Sequence: Synthetic oligonucleotide
cuuuggaguaaaaauaau

SEQ ID NO: 2597 - RNA, 18 nt, Artificial Sequence
  Description of Artificial Sequence: Synthetic oligonucleotide
uuuggaguaaaaauaauu

SEQ ID NO: 2598 - RNA, 18 nt, Artificial Sequence
  Description of Artificial Sequence: Synthetic oligonucleotide
uuggaguaaaaauaauuu

SEQ ID NO: 2599 - RNA, 18 nt, Artificial Sequence
  Description of Artificial Sequence: Synthetic oligonucleotide
uggaguaaaaauaauuua

SEQ ID NO: 2600 - RNA, 18 nt, Artificial Sequence
  Description of Artificial Sequence: Synthetic oligonucleotide
gaguaaaaauaauuuaga

SEQ ID NO: 2601 - RNA, 18 nt, Artificial Sequence
  Description of Artificial Sequence: Synthetic oligonucleotide
aguaaaaauaauuuagac

SEQ ID NO: 2602 - RNA, 18 nt, Artificial Sequence
  Description of Artificial Sequence: Synthetic oligonucleotide
guaaaaauaauuuagacc

SEQ ID NO: 2603 - RNA, 18 nt, Artificial Sequence
  Description of Artificial Sequence: Synthetic oligonucleotide
uaaaaauaauuuagaccu

SEQ ID NO: 2604 - RNA, 18 nt, Artificial Sequence
  Description of Artificial Sequence: Synthetic oligonucleotide
uacugauauaauuuucaa

SEQ ID NO: 2605 - RNA, 18 nt, Artificial Sequence
  Description of Artificial Sequence: Synthetic oligonucleotide
acugauauaauuuucaaa

SEQ ID NO: 2606 - RNA, 18 nt, Artificial Sequence
  Description of Artificial Sequence: Synthetic oligonucleotide
cugauauaauuuucaaaa

SEQ ID NO: 2607 - RNA, 18 nt, Artificial Sequence
  Description of Artificial Sequence: Synthetic oligonucleotide
ugauauaauuuucaaaag

SEQ ID NO: 2608 - RNA, 18 nt, Artificial Sequence
  Description of Artificial Sequence: Synthetic oligonucleotide
auauaauuuucaaaaggg

SEQ ID NO: 2609 - RNA, 18 nt, Artificial Sequence
  Description of Artificial Sequence: Synthetic oligonucleotide
uauaauuuucaaaaggga

SEQ ID NO: 2610 - RNA, 18 nt, Artificial Sequence
  Description of Artificial Sequence: Synthetic oligonucleotide
auaauuuucaaaagggaa

SEQ ID NO: 2611 - RNA, 18 nt, Artificial Sequence
  Description of Artificial Sequence: Synthetic oligonucleotide
uaauuuucaaaagggaau

SEQ ID NO: 2612 - protein, 4 aa, Homo sapiens
QTRV

SEQ ID NO: 2613 - DNA, 32 bp, Artificial Sequence
  Description of Artificial Sequence: Synthetic oligonucleotide
  modified_base (10)..(32): a, c, t, g, unknown or other
caggtaagtnnnnnnnnnnnnnnnnnnnnnnn

SEQ ID NO: 2614 - DNA, 33 bp, Artificial Sequence
  Description of Artificial Sequence: Synthetic oligonucleotide
  modified_base (1)..(17): a, c, t, g, unknown or other
  modified_base (30)..(30): a, c, t, g, unknown or other
nnnnnnnnnnnnnnnnnyyyyyyyyyyyynagg

SEQ ID NO: 2615 - DNA, 58 bp, Homo sapiens
gtaggtgaaggcaggaggaaggcgggctgggtcacaacagggagggaagaaggagatg

SEQ ID NO: 2616 - DNA, 68 bp, Homo sapiens
cctctaaatgtaccctgctttttcccaccttttctttctctgttcgccctcactgtgccttgtcccag

SEQ ID NO: 2617 - DNA, 58 bp, Homo sapiens
gtggaaattacaatgtcatttatcttctccgtgtcccatccccatccatcccactgtc

SEQ ID NO: 2618 - DNA, 77 bp, Homo sapiens
cactgctaggggactggcatccaggcccccttgaagcgtctcaataagtccgcgctctcctttttggtgtcttgcag

What is claimed is:

1. A method of increasing expression of a target protein by cells having a retained-intron-containing pre-mRNA (RIC pre-mRNA) that encodes the target protein, wherein the RIC pre-mRNA comprises a retained intron, an exon flanking 5' splice site of the retained intron, and an exon flanking 3' splice site of the retained intron, the method comprising contacting the cells with an antisense oligomer (ASO) complementary to a targeted portion of the RIC pre-mRNA encoding the target protein, whereby the retained intron is constitutively spliced from the RIC pre-mRNA encoding the target protein, thereby increasing level of mRNA encoding the target protein, and increasing the expression of the target protein in the cells, wherein the target protein is Ras/Rap GTPase-activating protein SynGAP (SYNGAP1) or Nav1.1; wherein:

(i) the ASO does not increase the amount of the target protein in the cells by modulating alternative splicing resulting from mutation of a gene encoding the target protein, and (ii) the ASO does not increase the amount of the target protein in the cells by modulating aberrant splicing resulting from mutation of a gene encoding the target protein; and wherein the targeted portion of the RIC pre-mRNA is within the retained intron.

2. A method of treating Autosomal Dominant Mental Retardation 5 (MRD5) or Dravet Syndrome (DS) in a subject in need thereof by increasing expression of a target protein by cells of the subject, wherein the cells have a retained-intron-containing pre-mRNA (RIC pre-mRNA) that encodes the target protein, and wherein the RIC pre-mRNA comprises a retained intron, an exon flanking 5' splice site of the retained intron, and an exon flanking 3' splice site of the retained intron, the method comprising contacting the cells of the subject with an antisense oligomer (ASO) complementary to a targeted portion of the RIC pre-mRNA encoding the target protein, whereby the retained intron is constitutively spliced from the RIC pre-mRNA encoding the target protein, thereby increasing level of mRNA encoding the target protein, and increasing the expression of the target protein in the cells of the subject;
wherein the target protein is deficient in amount or activity in the subject;
wherein:
(1) when treating MRD5 the target protein is SYNGAP1, and
(2) when treating DS the target protein is Nav1.1; and
wherein:
(i) the ASO does not increase the amount of the target protein in the cells by modulating alternative splicing resulting from mutation of a gene encoding the target protein, and
(ii) the ASO does not increase the amount of the target protein in the cells by modulating aberrant splicing resulting from mutation of a gene encoding the target protein; and
wherein the targeted portion of the RIC pre-mRNA is within the retained intron.

3. The method of claim 2, wherein the targeted portion of the RIC pre-mRNA is in the retained intron within a region +6 relative to the 5' splice site of the retained intron to −16 relative to the 3' splice site of the retained intron.

4. The method of claim 2, wherein the targeted portion of the RIC pre-mRNA is in the retained intron within:
(a) a region +6 to +499 relative to the 5' splice site of the retained intron; or
(b) a region −16 to −496 relative to the 3' splice site of the retained intron.

5. The method of claim 2, wherein the method treats DS.

6. The method of claim 5, wherein the RIC pre-mRNA comprises a sequence with at least 90% sequence identity to a sequence selected from the group consisting of SEQ ID NOs: 4-7.

7. The method of claim 5, wherein the targeted portion of the RIC pre-mRNA comprises a sequence with at least 8 contiguous nucleic acids of SEQ ID NO: 2593.

8. The method of claim 5, wherein the ASO comprises a sequence selected from the group consisting of SEQ ID NOs: 63, 69, 246, 247, 251, 255-258, 2599-2601, 2607 and 2608.

9. The method of claim 2, wherein the method treats MRD5.

10. The method of claim 9, wherein the RIC pre-mRNA comprises a sequence with at least 90% sequence identity to a sequence selected from the group consisting of SEQ ID NOs: 8 and 9.

11. The method of claim 9, wherein the targeted portion of the RIC pre-mRNA comprises a sequence with at least 8 contiguous nucleic acids of a sequence selected from the group consisting of SEQ ID NO: 2592, 2594, and 2595.

12. The method of claim 9, wherein the ASO comprises a sequence selected from the group consisting of SEQ ID NOs: 1052-1054, 1056, 1688, 1689, 1694, 1778-1781, 1783-1785, 1998-2000, 2002 and 20041038 2591.

13. The method of claim 2, wherein the deficient amount of the target protein is caused by haploinsufficiency of the target protein, wherein the subject has a first allele encoding a functional target protein, and a second allele from which the target protein is not produced, or a second allele encoding a nonfunctional target protein, and wherein the ASO binds to a targeted portion of a RIC pre-mRNA transcribed from the first allele.

14. The method of claim 2, wherein the subject has
(a) a first mutant allele from which
(i) the target protein is produced at a reduced level compared to production from a wild-type allele,
(ii) the target protein is produced in a form having reduced function compared to an equivalent wild-type protein, or
(iii) the target protein is not produced, and
(b) a second mutant allele from which
(i) the target protein is produced at a reduced level compared to production from a wild-type allele, or
(ii) the target protein is produced in a form having reduced function compared to an equivalent wild-type protein.

15. The method of claim 2, wherein the target protein is produced in a form having reduced function compared to an equivalent wild-type protein.

16. The method of claim 2, wherein the target protein is produced in a form that is fully-functional compared to an equivalent wild-type protein.

17. The method of claim 2, wherein the ASO increases amount of the target protein in the cells by at least about 1.1 fold.

18. The method of claim 2, wherein the ASO increases amount of the target protein in the cells by at least about 1.5 fold.

19. The method of claim 2, wherein the ASO increases amount of the target protein in the cells by at least about 2 fold.

20. The method of claim 2, wherein the cells are contacted with the ASO ex vivo.

21. The method of claim 2, wherein the ASO is administered to the human subject by intravitreal injection, intrathecal injection, intraperitoneal injection, subcutaneous injection, intravenous injection, subretinal injection, intracerebroventricular injection, intramuscular injection, topical application, or implantation.

22. The method of claim 2, wherein the ASO comprises a backbone modification comprising a phosphorothioate linkage or a phosphorodiamidate linkage.

23. The method of claim 2, wherein the ASO comprises a phosphorodiamidate morpholino, a locked nucleic acid, a peptide nucleic acid, a 2'-O-methyl, a 2'-Fluoro, or a 2'-O-methoxyethyl moiety.

24. The method of claim 2, wherein the ASO consists of from 8 to 50 nucleobases.

25. The method of claim 1, wherein the targeted portion of the RIC pre-mRNA is in the retained intron within a region +6 relative to the 5' splice site of the retained intron to −16 relative to the 3' splice site of the retained intron.

26. The method of claim 1, wherein the target protein is Nav1.1 and the RIC pre-mRNA comprises a sequence with at least 90% sequence identity to a sequence selected from the group consisting of SEQ ID NOs: 4-7.

27. The method of claim 1, wherein the target protein is Nav1.1 and the targeted portion of the RIC pre-mRNA comprises a sequence with at least 8 contiguous nucleic acids of SEQ ID NO: 2593.

28. The method of claim 1, wherein the target protein is Nav1.1 and the ASO comprises a sequence selected from the group consisting of SEQ ID NOs: 63, 69, 246, 247, 251, 255-258, 2599-2601, 2607 and 2608.

29. The method of claim 1, wherein the target protein is SYNGAP and the RIC pre-mRNA comprises a sequence with at least 90% sequence identity to a sequence selected from the group consisting of SEQ ID NOs: 8 and 9.

30. The method of claim 1, wherein the target protein is SYNGAP and the targeted portion of the RIC pre-mRNA comprises a sequence with at least 8 contiguous nucleic acids of a sequence selected from the group consisting of SEQ ID NO: 2592, 2594, and 2595.

31. The method of claim 1, wherein the target protein is SYNGAP and the ASO comprises a sequence selected from the group consisting of SEQ ID NOs: 1052-1054, 1056, 1688, 1689, 1694, 1778-1781, 1783-1785, 1998-2000, 2002 and 200/14-038 2591.

32. The method of claim 1, wherein the target protein is produced in a form having reduced function compared to an equivalent wild-type protein.

33. The method of claim 1, wherein the target protein is produced in a form that is fully-functional compared to an equivalent wild-type protein.

34. The method of claim 1, wherein the ASO comprises a backbone modification comprising a phosphorothioate linkage or a phosphorodiamidate linkage.

35. The method of claim 1, wherein the ASO comprises a phosphorodiamidate morpholino, a locked nucleic acid, a peptide nucleic acid, a 2'-O-methyl, a 2'-Fluoro, or a 2'-O-methoxyethyl moiety.

36. The method of claim 1, wherein the ASO consists of from 8 to 50 nucleobases.

* * * * *